US007585668B2

(12) United States Patent
Buelow et al.

(10) Patent No.: US 7,585,668 B2
(45) Date of Patent: Sep. 8, 2009

(54) HUMANIZED IMMUNOGLOBULIN LOCI

(75) Inventors: Roland Buelow, Palo Alto, CA (US); Wim van Schooten, Sunnyvale, CA (US); Josef Platzer, Geretsried (DE)

(73) Assignee: Therapeutic Human Polyclonals, Inc., Mountain View, CA (US)

( * ) Notice: Subject to any disclaimer, the term of this patent is extended or adjusted under 35 U.S.C. 154(b) by 554 days.

(21) Appl. No.: 10/893,483

(22) Filed: Jul. 15, 2004

(65) Prior Publication Data

US 2006/0026696 A1 Feb. 2, 2006

Related U.S. Application Data

(60) Provisional application No. 60/487,733, filed on Jul. 15, 2003.

(51) Int. Cl.
*C12N 15/13* (2006.01)
*C12N 15/85* (2006.01)
(52) U.S. Cl. .................. 435/320.1; 536/23.53; 536/24.2
(58) Field of Classification Search .............. 435/320.1; 536/23.53, 24.2
See application file for complete search history.

(56) References Cited

FOREIGN PATENT DOCUMENTS

| EP | 0 491 057 | 7/1991 |
|---|---|---|
| EP | 0 583 980 | 8/1993 |
| WO | WO 92/03918 | 3/1992 |
| WO | WO 97/16537 | 5/1997 |
| WO | WO 00/46251 | 8/2000 |
| WO | WO 00/75300 | 12/2000 |
| WO | WO 01/19394 | 3/2001 |
| WO | WO 02/12437 | 2/2002 |
| WO | WO 02/12437 A2 * | 2/2002 |
| WO | WO 2004/003157 | 8/2004 |

OTHER PUBLICATIONS

Gallarda et al. (1985) J. Immunol., vol. 135 (6) 4222-4228.*
Brüggemann et al., "A Repertoire of Monoclonal Antibodies with Human Heavy Chains from Transgenic Mice", Proceedings of the National Academy of Sciences USA, vol. 86, No. 17, pp. 6709-6713, Sep. 1, 1989.
Brüggemann et al., "Strategies for expressing human antibody repertoires in transgenic mice", Immunology Today, vol. 17, No. 8, pp. 391-397, Aug. 1, 1996.
Jakobovitis et al., "Analysis of Homozygous Mutant Chimeric Mice: Deletion of the Immunoglobin Heavy-Chain Joining Region Blocks B-Cell Development and Antibody Production", Proceedings of the National Academy of Sciences USA, vol. 90, No. 6, pp. 2551-2555, Mar. 1, 1993.
Ros et al.,, "Sequence Analysis of 0.5 Mb of the rabbit germline immunoglobin heavy chain locus", Gene: An International Journal on Genes and Genomes, vol. 330, No. 14, pp. 49-59, Apr. 14, 2004.

Hesse et al., "V(D)J Recombination: A Functional Definition of the Joining Signals" Genes and Development, Cold Spring Harbor Laboratory Press, Plainview, NY, US, vol. 3, No. 7, (1989), pp. 1053-1061 XP009043633 ISSN: 0890-9369.
Database EMBL Jul. 16, 1998 (Jul. 16, 1988), "rabbit Ig Germline CL42.Vh25 and CL. 42Vh34 Genes, VHA3 Allotype, 5'end" XP002393777 retrieved from EBI Database Accession No. M12180.
Volgina et al., "A Single 3'α hs1,2 Ehancer in the rabbit IgH Locus" Journal of Immunology 165:6400-6405 (2000).
Yu et al., "An Efficient Recombination System for Chromosome Engineering in *Escherichia Coli*" PNAS, vol. 97, No. 11, pp. 5987-5983 (2000).
Zhang et al., "Risk of Tuberculosis Infection and Tuberculous Meningitis after Discontinuation of Bacillus Calmette-Guerin in Beijing" Am J Respir Crit Care Med 162:1314-1317 (2000).
Muyrers et al., "Rapid Modification of Bacterial Artificial Chromosomes by ET-recombination" Nucleic Acids Research 27(6):1555-15557 (1997).
Butler, "Immunoglobulin Diversity, B-cell and Antibody Repertoire Development in Large Farm Animals" Rev. Sci. Tech. Off. int. Epiz. 17(1):43-70 (1998).
Reynaud et al., "Somatic Hyperconversion Diversifies the Single $V_H$ Gene of the Chicken with a High Incidence in the D Region" Cell 59:171-183 (1989).
Lee et al., "A Highly Efficient *Escherichia Coli*-Based Chromosome Engineering System Adapted for Recombination Targeting and Subcloning of BAC DNA" Genomics 73:56-65 (2001).
Hole et al., "Identification of Enhancer Sequences 3' of the Rabbit Ig $_K$L Chain Loci" The Journal of Immunology 146(12):4377-4384 (1991).
Lauster et al., "Promotor, Enhancer and Silencer Elements Regulate Rearrangement of an Immunoglobulin Transgene" EMBO Journal 12(12):4615-4623 (1993).
Mansikka et al., "Bursectomy of Chicken Embryos at 60 Hours of Incubation Leads to an Oligoclonal B Cell Compartment and Restricted Ig Diversity" Journal of Immunology,145(11):3601-3609 (1990).
Muyrers et al., "Techniques: Recombinogenic Engineering-New Options for Cloning and Manipulating DNA" Trends in Biochemical Sciences, 26(5):325-331 (2001).
Pain et al., "Chicken Embryonic Stem Cells and Transgenic Strategies" Cell Tissues, 165:212-219 (1999).
Reynaud et al., "Hypermutation Generating the Sheep Immunoglobulin Repertoire is an Antigen-Independent Process" Cell, 80:115-125 (1995).
Dufour et al., "The Sheep Ig Variable Region Repertoire Consists of Single $V_H$ Family" Journal of Immunology, 156:2163-2170 (1996).

(Continued)

*Primary Examiner*—Anne Marie S Wehbe
(74) *Attorney, Agent, or Firm*—Ginger R. Dreger; Goodwin Procter LLP

(57) ABSTRACT

The present invention concerns methods and means to produce humanized antibodies from transgenic non-human animals. The invention specifically relates to novel immunoglobulin heavy and light chain constructs, recombination and transgenic vectors useful in making transgenic non-human animals expressing humanized antibodies, transgenic animals, and humanized immunoglobulin preparations.

3 Claims, 47 Drawing Sheets

OTHER PUBLICATIONS

Sang, "Transgenic Chicken-Methods and Potential Applications" Tibtech, 12:415-420 (1994).

Sherman et al., "Transposition of the Drosophila Element Mariner into the Chicken Germ Line" Nature Biotechnology, 16:1050-1053 (1998).

Genbank, AY495827, Platzer, J., Direct Submission: Nov. 2003.THP Gmbh, Am Neuland 3, Bernried 82347 Germany.

Genbank, AY495828, Platzer, J., "Sequence Analysis of 0.4 Megabases of the rabbit Germline Immunoglobulin Kappal Light Chain Locus" Direct Submission: Nov. 2003. THP Gmbh, Am Neuland 3, Bernried 82347 Germany.

Genabnk, AY495826, Platzer, J., Direct Submission: Nov. 2003. THP Gmbh, Am Neuland 3, Bernried 82347 Germany.

Etches, R.J., et al., Strategies for the Production of Transgenic Chickens, *Methods in Molecular Biology*—62:433-450 (1997).

* cited by examiner (a)

(b)

chicken lambda
36259 bp

Figure 9b Seq ID 186 agaggatcctattaattgtttgttaattaagaggacaggaattcagtgtcaggggctgctctttgcttcccaatgtgtaccactgaa
gcctctctggatttatcagagatactcaatggactcttaacagcactgtggcacctgacctcctgctgccttcagcctcccttcctgg
ctggtgtgcttgtgttgaggagctgtgggaggctggtgcagttctgtgggatgaggtaaggccagctgaatagcctgggggctg
gtcagggggcttagtgagaggagcagggctggggaatattgtgaacagcaggtggtgccactgctattctgaggaaggaggc
agcttctgcaaatgctttgcaatgcaggatgacaaagtgcttctgctagctctaggcccttgctcatggctgtgatggtgcttaacg
gtgccagagtgcagacaaatagatgtgtacagctgctctgggagtaacaacaacaactatggctggtaccagcagaagacacc
tggcagtgccctctcactgtgatctatcaaaacacaaagagaccttcaggtatatctttatacttcagctggtaccagcagaagac
ctctggcagtgcatctgtcgctgtgctgaaaccaacagacacaccaacaccacaggacagcttcttgcagttctccatctcctggt
gcagcttcatgagcacgttaaccatcgtggggattcaagctgaggatgtagctgtctatccctgtggcaacagggacagcagtg
gtaagcctggtgaggtgatacagggagatgtcaaaaaaaaagaaaaacccaacatgtatgggg ttaaaaatggaggctctctgc
cctttctctcatggctgagctgggctgtgcagtgaggtaagttcctgtctcgtctgcaaagcactgtctgaatggtctccctattgtg
tgttgtggtgcatgagggattctggggacagagggcatttgtctgtccctataaaggcccaaagcccctggctgtgtacagtaagt
ccgcctggggcacctgagctgtgggcaggtactgccaggagaggggctcaggccatgatccaataccaatggctctgtgtccc
catgctaatagggctatgctgcagcccatcactccctcttaaaccccctcttaaacttcctacagttctaagttctatctctctcctcca
attaatcatcgtcaccatacagcatcagtgctgtcatcccagttcccccagtaatagacagcctcgtcctcgacttggaccccagtg
atggttaacgtgcttgtggttctgcctggggagccggagaatcgtgaagggatgttcgagggtctgttggtgttgtcatagatcac
agtgacaggggcactgccaggtgccttctgctggtaccagccatagtagctgctatccccggagcaggtgatctcaacggtttct
cccggg ttcgctgacaccgaggccggctgagtcagaggagagaggggagaaaatggagctcagtgagtgtgcgacacaca
cagccctcagcgtactgcggtgggataatacttctgagcacacagtcccaaatggaacctcaggactctctcatctgcttcaggat
gaacaatgtctatggctgctcccagcagaggactcctggcagtgcccttgttgctgtgatataggggggccagcaggagaccctc
agacgttgctttgtactttccatgttccaaatcctgctgcatgcacaaattaactctcgtggagattcaagccaagggtgagactgtc
tattactgtggtgcctgggaaggcagcagtaatcctggtttggtgatacagggagatgtgcctcccccaaaaaaacccccaaaca
aacaaaaagcatatataggggg taaaaatggagtttttctgcccatctgtctcacagccaagctgggctgtgcagctgcggcagg
ttcctggcctctctgcaaagctctgtttgtgaatggccttccttcctcttgtaccttgtggtgcaggaggagattgtggggacagaag
ccacttctccttgtccctacaaaggcacagcactgtgtcatcccagccctcctccatgttactgctggcagtcccgtcctcctgctt
ctgaagagacatggatgtaggtgaggtctcttctgcaacagtggtgttcatcaccccacagctgccaggtgagggctgtgtgtgt
cggacatttggctgagctccatttctctcctgtccctctccaggttccctggtgcaggcagcgctgactcagccatcctcggtgtc
agcaaacctggga ggaaccgtcgagatcacctgctccgggggtagcaacaactatggctggtatcagcagaagtctcctggca
gtgccctgtcactgtgatctatcaaaacaccaagaggccctcgggtctctcttcataactttcttgttcctcatctggctctgcaaac
acgttaaccatcactgggg tccaagccaaggatgaggctgtctattactgtggtggctgggatagctgctgcctgagtcagtgct
gcctgcaccagggaactgggagaggagaggggggagaaaatggagttcattgagtccctgatatacggagtccttgctaggc
aatgagataagacagctgagcccacagaccatcttttactacagctggtaccagcagaagacgcctggcagtgcatctgtcact
gtgatctatgctgacaccaacagacccaccaacaccacgggg cagcttctcacaatcctacacgttctggtgcagcttcatgagc
acattagccattgtggggactcaagctgaggatgtggctgtctatttctgtggcagcagggacagcagaggtaagcctggtgag
gtgatacaggagatgtcaaaaaaaatgaaacaacatgtataggagttaaaaatggaggttttctgctctcttctctcacaggtga
gctgggctgtgcagtgagatgagttcctgtcccctctgcaaagcactgtctgaatggtctccctgctgtgtgttgtggtgcatgagg
agagtctgaagacagagggtacttctccctgtccctgagaagctgctgcatggtgtcatcccagccctgctgcatgttacactgt
ctgccctgtccttctgatgccgaagctgcttccatgctgggatgctctgggctgagctctgattctccaaaatggcagtggtttcttct
gatggtggtgg tattcctcattctactgctgtgcaggg agggctgtgtgtgttggctacccactgagccctgtttctctcctctcc
ctctccaggttccctggtgcaggcagcgctgactcagccggcctcggtgtcagcgaacctggg aggaacagtcaagatcacct
gcaccagggatgacagctggtatggctggcacctgcagtgaggggcattgaggctgggaacaatgcagtgctgtgcctttgca
ggaacagggataacggggcactggacccagaattgattactgaatgaaaaggttcagtaagagaggacatgcgtgtgatgtac
agtctggcagaagggactggattctccctcagccctgactcaacaagggcagaaagccttggttttgaatcgcagtctgcatgtc
accccacatctccccacatcactataccagcactattgctcctgtcccaatcaccacagtaatagacagcctcgtcctcgacttg

Figure 9b Seq ID 186 (con't)

gaccccagtgatggttaatgtggccgtggagccggatttggaaccggagaatcgtgaagggatgtccgagggtctgctgctgct
atcataaatcacagtgacaggggcactgccaggtgatttctgctggatccagccatagtagctgctgctaccagagcaggtgatc
ttgacagtttctcctgggtttgctgacactgaggttggctgagtcaggttactttgggacctgagccagactgtacctgtccctacaa
aggtacagcactatgtcatccccagccttgcttcatgttgctgctgcaagccctgttctcctgctggagctgtctctgtgctgggatg
ctctggtctggactctcatcttctaatgtgccggtggccatgactgaggtttcttctcctttaatagtggtgctcccttttcccactgttgt
acgcagagggctgtccatgtggggtattccctgagccccactttctctcctctccctctccaggttccctggtggaggcagaactc
attcagccgacctcggtgtcagcaaaccctggggaaactgtcaagatcacctgcagtggaggtatcggccagtggtatggctgg
taccagcagaagtcacctggcagtgtgcctgtcactgtgatcaatgctaacaccaacagaccctcgaacatcccttcacgattctc
cggttcgctctccgtattcacacacacattaaccatcactggggtccaagctgaggatgaggctgtctattactgtggtgcctacga
cagcagctatgttggtatagtgccaggggggagatgaggcggtgaattgatggccagagctgaaaatgatgggtttccacccttct
ccattatgacttttgttgagatctcttctcatgatggtcttccctggttttcctgtggttggaaggagcagaaggcactggcaggggtc
ttgctgggagagctggcaatagcagggatagtggatgccccacatggaagaaagggacacagctatggccacttctgatgaga
ggtgtccagagcacagcagcacatccctgtgcttcagacatctcctgtgccctggggtgtggaagggaatgcattcatagcatg
gccaggtggaggtaagagtaacatgcctactgcagtaattctgcacatagagaaggaagaaagacagaaaatcttcctacagtt
ctaagtttcctctctcttctccaattaatcatcatcaccatacagcttcagtgctgctatcccagctcccacagtaatagatagcctcgt
cgtcggcttggaccccagtgatggttaatgtgcttgtggagccggatgtggaaccggagaatcgtgaagggatgttcgagggtc
tctggttgttgctatagatcacagtgacaggggcactgccaggagacttctgctggtgccagctatagtaataacttccatcatcgc
tgccaccccggagcaggtgatctcgacggttcctcccaggtttgctgacaccgaggccggctgagtcagcgctgcctgcacc
agggaacctggagagggagaggagagaggggagaaaatggagctcagtgaatgtgtgacacacagccttcagcatgctgca
gtgggactgagcaccagcacttgctcagctccattttctccaggttccctggtgcaggcagtgctgactcagctggccttgatgtc
agtgcatctgcgtgttactgattacaggttcagctgctctgggagtagtggcgactatggcagtaactgtcagggcagcaccagc
aaaaggcatctggcagtgctcctttctatgtgctgtacctgaacaccaacagaccctcgaacatcccttgcaattcaccggttcca
aatctggctccacagccacattaaccatcactggggtccaagccggcgacgaggctgtctattactgtggggagtgaagacagca
gcggtactggtgccacagtgacacagagcaatggagatgtgatacacaaacctgtcagtgcagggaacagttggcactggcac
tcatctactcctggactcacaactactatggctggtaccagcagaagtcacctggcagtgcccctgtcactctgatctatgctaaca
ccaacaggccctcgaacatcccttcacgattctccggttctggatccggctccacaaacacattaaccatcactgggggtccgagc
cgaggacgaggctgtctattactgtggtggctacgacggcagcactgatgctggtagtgacggggagatgtgaaactgaggta
cagccctgaattaaaaacgtctgttttctgcctttctcccttatgtttgttctgggctgtgtcactgaggcagttttccctctgcatggcc
atggctttgatcatcttttctgtcctgcctcagtgtttggaaggtgactctcccagttaccgcggaggaaccatgaagatcatttgctc
ctggtgtagcagtagctatggttgtggctgcatctggcttcaacagcaagttaaccattactcatgttgaaaccaaggatgaggctg
tctaagatgtgtgagctagcatagcagtgaggctggtagagtgacaaagggaagcatagctgtgatgtctacttctggagtgcac
tggggcatgaaagcgaaaacagtcaaagccacaaccacacggagggaacaggaacatgtctacagccataactctgcgtggc
caaaatgctgaaagtcagaaaaccagcagggagcggggctgggtgcagtgcatgccaacccttgtggggacagctgtagaa
catggaattcaatctcagtggagtcgaaccaattggcaggctgtcagcagaggcattcccagtgctccccttgtttaatgtgaaa
ttacaaacaacgctgccaggcaacaaactgtattgatctgcttgagggtaggaaggccttgtagacagatgaggataggcaaaa
atcaatgggctgtgtcaaacccattgacgttcaagaacgttaagtcccagggcctgcacttaggtcataacaacacaaggcagca
gtgtaggctgaagagatggttgattagagggttctgttagaatggttcaattctgtgatcatgaagataacttccaaacaaaattggt
gtaggatagggataaggtgctctggccccagaatcacctgcaacaaaaaatacagcagggagggcataaacaattgcggccct
gcagaggggcagggcatctgcctcagccccattagtgaagggatgcttaagagtctaccggtgttaccatagatcacagtgaca
ggggcaccgccaggagacttctgctggtaccagccataagcatcgctactgcctgagcaggtgatcttgacggttctcctgggt
ttgctgacatgaaggccagctgagtcggtgctgcctgcaccagggaacctggaggggggagaggagagaaaatggagctcag
taagtgcctgacacgcaacacccagtgccagaagatagcactgatccccaagacaaggagaccatgcatgccaaagaggttc
ctctttctctcccacttcctctcagtccggctctagggtctcccctccttcctcctgctctccttcaccctgtacatcagatcccagggc
tttgctgcatttctgctcctgcaggcattgcctggggccctgtggcaagaccagggatcagtcactctgggagtagccatgagtat

Figure 9b Seq ID 186 (con't)

ggctggttccaggagaaacctggtagtggtgctgtgactgtgatccacagtgacaccaacagaccctcgaacatcccttcacaat
tctccagttccaccccgcagtgccaccaccagcatatccactatcagtgctgctgtcgaagctcccacagtaatagacagcctcg
tcctcggcttggaccccagtgatggttaatgtgcccgtggagccggatgtggaaccggagaatcgtgaagggatgcccgaggg
tctctcatcatcccagtagatcacagtgacaagggcactgccaggagacttctgctggaaccagccatagctatagctgccccca
gagcaggtgatcttgacggtttctcctgggtttgctgacaccgaggccggctgctgagtcagtgctgcctgcaccagggaacct
ggagagggagaggagagaggggagaaaacggcaatcagtggctgcctgacatacacagcttcccccccgcaaagcagcagg
acagaggccccatgcccataCaggcccaggtcacctgaactgttggtgaccatcactagtaggagaggggcccagaccatgg
tgctactccaacagttgtgctatggaccccaactccttttagaccccccaccccttctacagcacagccacctcctgcaagcctggt
gtccatggatactggccaccccccatcccatgctccccttgcctcctgtagccattttccttgatctcagaagaccaatcatggttagc
cattactgggatccaaaatgagcacaagactatctactactgcggtagcttgggaaacagcactgatactggtagaatggcacag
ggagatgggaaactgagttacaaacctgagttcaaaatggaagctttctgcacttactgcattatggctggacagggctgcaggg
gctgagtcctgtttctgtcctctctgcacggccctgactgtaaatggcctcctctctcttcttaaccacaatgtacctgtccctgccca
ggcacagcactacgtcaaccctagccctgctccatgttgctgctgtgagctcctatctccttctagagctgcctttgtgctgagatg
ctctgtgctgggctcttgcccacaaacatacctatgtctgtgactgaggacccttctcctctgatggtagtgcttcccctgcggttgg
ggagggcagggcaaattgggcacctgttgagccccatttactcccctctccctatgcaggttccctggtgcaggcagcgctgact
ctgccagactcattatcagcaaacctgggagaaactgtcaggataacctggtctggaggtagctatgattatggttggcaccagc
agaaatcacctggcagtgcccctgtcactgtgatctataacaacaacaagagaccctcagacatcccttcacgattctccggtgc
cctatccggctccacagccacattaaccatcactgggtccgagccgaggacgaggctgtctatttctgtggtgcctgggaaag
cagcagtaatcctggtatggtgatagggggcgatgtggggggaaaaaaaaaaaaaaaaagacacatataggggataaaaat
ggaggttttctgcccatctgtctcacagccaagctgggctgtgcagctgaggcaggttcctggcccctctgcaaagcactcgttgt
gaatggtctccctcttgtacagtgcagtgcaggaagagataccaggtatgtccagacctgtttgctgttactgctggcagacctatc
ctcctgctttgaagaggcatggatgtctgtgaggcctcatctgccagggtggtgttcctcatcccaccccctgccaggtgagggct
gtgcgtgtcaggcaaacactgagcccccatttctccccctctccctctccaggttccctggtgcaggcagcgctgactcagccggc
ctcagtgtcagcaaacctgggaggaaccgtcaagctcacctgctccgggagtagcagtggctatggttatggctggtaccagca
gaagtctcctggcagtgcccctgtcactctgatctatagcaacgacaagagaccctcggacatcccttcacaattctccggttcta
aatccggctccacgggcacattaaccatcactggggtccaagccgaggacgaggctgtctatttctgtgggaatgcagacagca
gcagtactgataccacagtgactcagatgtaatacacaaacctcccggcagtgcaaggagcagataatacccttaactgtctgtct
tacaggttccacctccatcaataccccatgctgcagggctcaggtcctcttaggctgccaggctgcaccctgctggctccctccc
cactaccctacccccaccctttgcagtgtccctgcatgcactggggcaacacttcctcacctgtccgctccctgctggagggcc
acagccacctggttgatacatcagcatagcaccagttcttccccaagctggccctcccttggactctctactgagcccccatttctc
ccctctcctctccaggttccctggtgcaggcagcactgactcagccagcctcagtgtcagcaaacctaggagaaactcaggatc
acctgctctgggggtggcagtaacaatgcttatggctggttccagcagaaggcacctggcagtgcccctctcactgtgatctact
ggaatgacaagagaccctcaaacatcccttcacgattctccggttccaagtccggctccacagccacattaaccatcactggggt
ccgagccgaggacgaggctgtctattactgtgggagtgcagacagcagtggtgctggtcccatggtgacacacagcagtgag
gaagcgatgcacaaacctcctgacagtgcaaggagcagccggcaggttttgctgtctctgtttgatggtggcacaggacctcac
cacagccctaccttcactgtcctgcaatatgggtggctgtgcacggtgtcctgaacacgtcccaacaagatgcacagcactgcat
caggcccagcccctgcctgtagcagctgatgcccttgtccagcttctgcctgagctgcctctgtgctgggatgctccatgctgag
ctctgatcctccaaagtgcccatagctgtggctgggatcccttctgctctgatggtggtggcacattgcaggaacagagcccaga
ccagaacagctcagtacagagccagctccagcagggagagaatggggctgccagcagcaatgtggaacagctggggatgg
cacagagctgtgccttttcagggacaggtacagtgtgactcagtacccagagtaacctctcatacaactacatataccaaggaag
gcatttacaagcatggccatgcagagaagatataaatcatcctcagtctcacagacctgctcagccataaggcatcaagggtgaa
aaacctctatttttttttaaccctgatcaatccatcagttcctcacctcccgctgaggcaataccagcataagtgctgctgtcgtagcc
accacagaaatagacagcctcgtcctcggcttggaccccagtgatggttaatgtggctgtggagccggatttggaaccggagaa
tcgtgaagggatgtccgagggtctgttgttgttgttatagatcacagtgacaggggcactgccaggagacttctgctggaaccag

Figure 9b Seq ID 186 (con't)

ccgtagctgccactaccccggagcaggtgatcttgacggttcctcccaggtttgctgacaccgaggccggctgagtcagtgct
gcctgcaccagggaacctggagagggagagaaaacagggctctgtgtgtgtctgacacgcacagcctccttgtttggcagtgg
ggtgaggctgctgagcacacagacacacatgggacagcaggagacccacatctgctccaggattgacatctatggctggtacc
agcagaagatacctggcaatgccccatcactgggatccatgctaacactggtagacccacaggcgttctcttaccattctctggg
gtccaatccaggcctacacacatgaactgtcacactaactaccactgtggtctaagctgtggagaacactgcccattactgcggt
ggcaatgacaggagccaaggcctgaggatggcacttataccaggatagcaggacaaggggttcacaagaaaaaaagaaag
gttcttttttcctctcccgcttcctctcagtccagctctgtggtctcttctccttcctactgctctccttcaccctgtacatcagatcccag
ggcttcgctgcatttctgctcctgcaggcattgcctgggggcctgtggcaagaccagggatcagtcagtccgggagtagcaatg
agtatggctggttccaggagaaacctggtagtggtgctgtgactgtgatccacagtgacaccaacggaccctcgaacatcccttc
acaattctcctgttccccatctggctccacgcacgagctaaccatcactggggtccaagctgaggacaaggctgtatattaccgtg
gagactgaagagcagcagtgatgctgtattttgacaatgtgtagtaggaacataaacacagccacattcacagtaaagttttcagg
ccaccttccttggtccccgagctttgggaattgtgacttatgttactgttttgggaattcaggaggccttgtcctatctgaatggccaa
gaccttgactgttaccccagatcatattccaggaatgagggtgatactgggtatagacccccatcatccttgtccctctccaggttcc
ctggtgcaggcagcgctgactcagccggcctcggtgtcagcaaacccaggagaaaccgtcaagatcacctgctccgggggtg
gcagctatgctggaagttactattatggctggtaccagcagaagtctcctggcagtgcccctgtcactgtgatctatgacaacacc
aacagaccctcgaacatcccttcacgattctccggttccccatccggctccacaaacacattaaccatcactggggtccaagtcg
aggacgaggctatctatctgtggggagctacgaaggcagcactagtgctgtatggtgacaatgattaaaaggaactgaattaata
aattataagcctgttttctgcccatcttccttttggccatgcagaactgtggccatagcagtttcctgttccatctgcatggccatgcta
tgaatgcactccttccacaccgcagggcacaggagatgtctgaagcacagggatgtgctgctgtgctctggacacctctcatca
gaagtggccatagctgtgtccctttcttccatgtggggcatccactatccctgctattgccagcactcccagcaagacccctgcca
gtgccttctgctccttctaaccacagcagtgggtgctgcccccagagctgctcctctggatgctgtgccccacatttcctgaacac
acactgcccatccagcaatgtgggacagggaacaccacagcaggaagagacctcaatcacagccatagtggaggcagacag
aaacctgtcatttttagctctagacatcacatcactcccatatctccctgtgtctctgtacctacaaaactgctgtcataggccccact
aggacaggaacatgaatggggctctgcaaaggcagcgccacagcagctgtggacccagagagcagaactgactgccctcaa
cagctccgcccatgcagggagatgtgcagcaacaaggaggggaggaaatccaacagtgccgccaccagcataaccagcact
gctgtcgtagctcccacagaaatagacagcctcgtcgtcggcttggaccccagtgatggttaatgtgtttgtggagccggatgtg
gaaccggagaatcgtgaagggatgttcgagggtctcttgctgctttcatagatcacagtgacaagggcactgccaggagacttct
gctggtaccagccatagtagctgctgctaccaccccggagcaggtgatcttgacggtttctcctgggtttgctgacaccgaggc
cggctgagtcactgctgcctgcaccagggaacctggagagggagaggagagaaaatggggctcagtgcctgacacacactg
ccctcctcctcctcatggggaggagaccccagagcacacaagcacacacagaatattcaaacaccgacttctaatccatgct
taacagcaactatgactggtacaagcagaagactcctgacaataccactggcactttgtaatacctccacaataagcccccctctc
tcctctccctctccaggttccctggtgcaggcagcactgactcagccggcctcggtgtcagcaaacctggaggaaccgtcaag
atcacctgctccgggggtggcagcagctatggttacagctggcaccagcagaagtctcctggcagtgcccctgtcactgtgatct
atagcaacgacaagagaccctcggacatcccttcacgattctccggttccgcatccggctccacagccacattaaccatcactgg
ggtccaagtcgaggacgaggctgtctattactgtgcgaacttcgacagcagcagtactgctgttagtgacggggggagatgtg
aaactctctacagccctgaattaaaacatggatgttttctgcctttctccctcaggatcacgctgggctctgtcactcaggcaggttc
ccctctgcatggccacggctttgaacatctttcctgttctgcctcattgtataggactctcccagtacctggaaacaccaaaaagatc
atgtgctgcaggggtagcagcagctatggttatggctaatagcagatgacacctggcagtgcccatcactgtgatctacagtaa
caccaagagatccttcatgattctctggttccatatcccacgccacacacacacactatcactggggcccatgccaaggatga
ggctgcctattactgtgtaaatgcagacaacagttgtacagtactgcttcccactgacacagagcagcaggtacaactgatgcact
aacctcctgccagtgcagggagcagctggctcttttgctggctctgtttgatggcggtgctggttcctaccatggcccttccctcat
tgccctggactacatgtggcagggcaaaaatcacatcccagcactgacagcagggaacctgtggaccgctgagcagccagg
ccaaagctccctacttagaggggatgtttcccatggcacaaggctgggctggctgtgtttctcttctggcacgagggcagccaca
gaatctttcagatcaggatgattgttgtgatctgctcctacctcagctcaactggcatcacctacagcacagtgcccaggcctgtgt Figure 9b Seq ID 186 (con't)

gcaggtggctgtcagagatctccaaggaggagactccatgatctctccgggcagcctggatcagtgctacattacctgcggagt
aaggatgtgactcctgactctggccagacagaacctctgcgttcagtctgtgccactgcctcctgtactggtgctgaatgctgctg
gaaaaagcctggctctgttcactttgcaccctcctttcaggttagcgtaagggagaggagagaaaataggggctcagcaattgccc
aacatgcacagccctcaccaggctgtcagatgaggcacgcaattccacaaggacacatggggtagcaggatacccacatctgc
tccaggattgttaacaactacggctggttccagcagaagtcacctggcagtgctcctgtcactgtgatctatggtagcaccagtag
accctcaaacatcccttcacgattctccggttccgagtccggctccacagccacattaaccatcactgggtccgagccgagga
cgaggctgtctattactgtgggagtgcagacagcagtggtgctggtcccatggtgacacacagcagtgaggaagtgatgcaca
aacctcctgtccgtgcaaggagcagctggcaggttttgctgtctctgtttgatggtggcacaggaccccaccacagccctaccttc
actgacctgcaacatgggtggctgtgcacggtgtcctgaacacgtcccaacaagatgcacagcactgcatcaggcccagcccc
tgcctgtagcagctgatgcccttgtccaacttctgccagagctgcctctgtgctgggatgctccatgctgagctctgatcctccaaa
gtgcccatagctgtggctgggatcccttctgctctgatggtggttgcacattgcaggaacagagcccagaccagaacatcttagt
aaggaggcagctccagcagcagcagaacggggctgccagcagcagggaatgatgctgtgccacagtaggaacagggacca
agaggatcacttcccacgcaataaagtataaaagagagggcattcaaaaacacagccatgcagagcagagagaaacctgact
cagccccacagtcctgctcagccttaagtcagcaagtgcagaaaacctccatttcaactcaggtctgtaactcagttccacatcct
cttttgtctctataccagcattagtgctgctatcccagccaccacagcctcatcttctgaccttagtgacaactaaccacaattggtctt
ccagggcccagggaaatagctgcactgggacaggagctgccagtgaccatgaggttctgcatgagtgggctgtgttgtgggca
gttcagggtataaagaaaggagttggagtccatggcatagacccattggcataaggatgtgcatctgctgggatcacaccatgg
cctgtgcccctctcctgctggcagtgctgacccacagctcaggtgccccaggaacacccgttgtgcccagcctttgggcactgg
gccccatcccctgctttttaagacttggcatcaattcaccacaacacctctctgcagcaccataccaacatagctgctgccctg
ctcccacagaaatagacagcctcgtcctcggcttggaccccagtgatggttaatgtgcccatggagccggatttggaaccggag
aatcgtgaagggatgtccgagggtctcttgtcgttgtaatagatcacagtgacaggggcactgccaggtgacttctgctgatacca
gccatagctgccactactcccggagcaggtgatcttgacggttcctcccaggtttgctgacactgaggccggctgagtcactgct
gcctgcaccagggaacctggagaaggagagaagagaaatgggctcaacaagagcctgacacacacagccctcccaagca
gcagtgggatggggaacagcaccattaaaggaaaagggacttcagccatagccacatcaaaggatgagagcccagcccaga
gcagcccagcacagaggcagctccatggagcagggctggggatgacaagatgctgtatctttacaaggataggtacagtgtgg
gtaagtgtcagagtaatctctcatacatctaggtacagacaggagggcatttacaaacacggccacgcagagaggacagaaac
ctgcctcagccccacagcgctgataagccattactcagtaagtgcagaaagtttccattttaactcaggcctgttactcagtttcc
atctccctgtgtcactgatccccaacttggactccagtgaaggctaaccatgatcagccttctgtgagctgagaaaaggagtgtag
tgagcagggagagcactgcaataggagctgatagtgatcacacaggcctgtactatgggcagatgggagtttaagagtgaattg
cggtccatggcatatgcctgtcagcatagggatgctggaggaattgcaccttggcatgagccctctcctcctggtgatgcttgcc
cacagctctgacgtcctgggaaggctcactgcaccttgttgtcagtgaaactgcaataagctatcaagatttgatataattctgccc
ctctgatctacttgtgagaccacacctggagtactgcatccagttctggtaccaccaacacaaaaaggacatggagctgctggag
cagggccagaggagggccatgaagatgaacagagggctgaagcacctcccctatggggacaggctgagagacatggggct
tttgagactggagaagagaaggctccatgggaccttcagtgtccttccaatacttgaaagggtccttgaggaaagctggggagg
gacttcctataaggacatatagcaacaggacaaaaggaaagggttttaaactggaagaaagtagatttagtctagatagtaacaa
gaaattctttacagtaaggatcacgagacactgaaacaggttgcccaaagcagctgtggatgcccctccctggaagtgttccag
gccaggctggatggggctttgagcaacctgttctagtgagaggtgaccctgcctacagcaggggagttgaacctagatggctt
aaaggtcccttccaacccaaatcattctatggcaattctatagagaacacctatgctgagagtagctacaagtatggctggttcctg
gcagtgcccctgtctctgtgatctatagcagcaccaacagaccctcaaacatcccttcacgattctccggttccaaatctggctcca
cacacacattaaccatcactggggtccaagccgatgacgaggctgtctattactgtgggagcacagacagcagctatgttggtat
cacagtgacatggagcaattaaaaatgatgcataacctttgcacatctgtaatgctataaggtgagagaaagtaagcaataatag
cagagcagcacaatcctaggctacagcaaatgagaacaagcccagatgcagccacagaaataaagaaaaaaaaactgcttac
ctttagaaagcctcatatagacagggatctccagcaagatacccacacctccactgccaacccttaaatgagggctgggatggg
ctggatcctggctccacccctttcaatcactcaggtacattgcacacacctgagctcccctggctggccctgccttcccaccaggt

Figure 9b Seq ID 186 (con't)

gctcaatcactgctttgggctgtgactcagcatctccactacagcatcacagggagcggttgtcggtctctgctgttcctatgtggg
tgccccgggacacctgaaggcatgagtggcagtgagggctcccagctctatccatggtgaacagacattatgtttatgctttaca
gcagcatgaatctggcagtggtgttattgctgtgatgctgctgtctatgctcccacagtaatagatagcctcgtcctcggcttggac
cccagtgatggttaatgtgtttgtggagccggatccagaaccggagaatcgtgaagggatgtccgagggtctgttattgccattat
agatcacagtgacaggggcactgccaggcatagtcgctgtaaccccggagcaggtgatctcgacggttcctcccaggtttgct
gacaccgaggccggctgagtcagcgctgcctgcaccagggaacctggagagggagaggagagagggagaaaatggatc
tgagcaattgcctgacacacacagccctccccagactgtgggatgaggccctgtgcccgcagtcacatgtggaatatcaagaca
cacacatctatgacaatcacaatctgattatcaaccactatggctggtaccagcagaaggcacctagcagtgcccctgtcactctg
atctactatgatgatgagagaccctcgaacatcccttcacgattctccggttccaaatccggctccacacacacattaaccatcact
ggggtccaagccgacgacgaggctgtctattactgtggggaatgaagacagcagcggtactggtgccccagtgacacagagca
atggagatatgatacacagacctgacatctcagggagcagctggtcattatcctggtgacacaagtcccaggcatggcccagca
ctgtgctgcaggtggctatgccgggtgccctgctctgccctcctgtagagcctcaggactgtgcccatcactcagggaggagat
ggtcccagcagccttgtccctgccctgcactgcacttagctcctggaccccatctcctgctgcccacccatattgcctccctgtgtt
gctgttgcagggttgcttctgcctcatactggtttctcccttctggaggtggccaaaagccgggccctgtgcaatcctggtgcataa
ataccttatggcccctaagtagggcaggtgtgggacacgctctggcacctggggtgtgtgcaagtgctcaggaagacctgcag
gcacaggtggcagtggggggtctctggctgtgctcgagcagcagctgcctggggtaagggtagtactctgtgcatgaacaatg
ctgcagggctcagctctgctcagaccacgaccctggcaccaacagagacctgcctggctctgtggtcatgtaaacctttacagg
agctcaagacaaggctgtttattactgctctggcaggaaagaagcactggccatggtcatagagagttccagcaacaggaaagt
gagagcccaagctgctgaggtaccagggctcctcaggtgcctgctgcagcagcttggacacagtcgaggaacagcaattgtac
ctgtgtggtggatcaggctgtgctgcctgtgaacctattctagcacatctgtcacctctgtgccactcacagggataccaccctga
gacccctaccccatcagcctctgtgtgggatatggtgttgggcccaagggctctgttgcacagggagatagaggcctggggag
gagggaaagcattgaggtggtgttgataccagggatgtgagcccaagcaagagatcagcagagcaaggaggaagaattgca
ggtgttggggctggggaaagccccagatggctggagctggtggggccactggagatctcctcctcccatcctgctccatgctg
gggcagctgctgcaggctgaccagggcctgcccgggcacgttgtgaaggtcaccaaggatggagacttcagagctatctggg
acacgtgttttaacgtttgatcagccttgcagcaaaacagtgttttgctctattgaacagtgttcaacaaaaacgatcagtggcctgg
aacacatctcctacgaagaaaggttgcgagagctgggtctggagaagagaaggctctggggcaacctccctgtggcctgtcag
tgcttaaaggaggctcaagagaaagatggagagagactttatacacggagctgtagcaatatgacaaggagaaatggtttaaaa
tggaaagagggtagatttaggttagctatcaagaagaaattcttcactcagaggtgatgaagcactgtagcaggttcccagaga
agtattggatgcttccttcctggcagggcccaaggccagactggatgggttctgggcagcctgttctggtgggagatgtccctgc
ctgtggcatggcttggaaatgggtagcctttgaggtccctctcagcccaaatcattctatgttcttgtggttccctgcatttcagccttt
gcctgttgactctggtgccactgttggacaattctactcagctgcgtttcatccctgccccaaagcagtaatcccatggataagcaa
tgctctgaggccttcaccaccctcagggctcctgctgacccctagcggcctccctggcagcatgagcccttgttgtccgcactgct
gctgctgagggtcctgccagcccccaggggcctttctgcccaggcactgccacctgctaaaacccagcctgcccatggcagg
gcatcgcatgtctgagggatggaacggggcaagggcagtgctgcaggcagtggttcaagaaacgtttagatgttgtactgagg
gatgtggtttagtgggaaatactggtgataggtggatggttggactggaggatcttagaggtcttttccaaccttggtgattatgtga
ttctatgaagggagccatagcctgctcccatcatgccccgccagtccggctctcccgagcactttggttccgcagcatccaggcc
cgctctggggccggtgtgggcctgggtgctgccacgtgtccccgctgcaaggcctggccaacccgctgtgccacaatgcag
gggctgggctaggagtgggcagggaggtgtggggagaggcgtaggacgtggctgggagcgcagggagttatttgcatagg
ggggcgtgctgcggaaggacgcgggtataaaagggcatcgaggtccccggcacagccccatcggcgtggggacacacagc
tgctgggattccgccatggcctgggctcctctcctcctggcggtgctcgcccacacctcaggtactcgttgcgcccggtcggg
actgtgggcacggggctctgtcccattgctgcgcgggcagggctgtgcgtgcggggccgtcactgattgccgttttctcccctct
ctcctctccctctccaggttccctggtgcaggcagcgctgactcagccgtcctcggtgtcagcgaacccgggagaaaccgtcaa
gatcacctgctccggggataggagctactatggctggtaccagcagaaggcacctggcagtgcccctgtcactctgatctatga
caacaccaacagaccctcgaacatcccttcacgattctccggttccaaatccggctccacagccacattaaccatcactggggtc

Figure 9b Seq ID 186 (con't)

caagccgacgacgaggctgtctattactgtggggagtgcagacagcagcagtactgctgcacggtgacacaaagcaatggggaa
aatgatacaaaaacctcctgccagtgcaaggagcagctgatggttttactgtctctgtcttacaagtcccacctccattcctgccct
gtgctgcagggcccaggtcctcctgcattccaggctgcaccccaggtccagctggctgcctccctgccatccaacatccacca
tttgtagtgtccctgcatgcaccaggctggcagctcctcatctgctcctgctcccactgagaccacctgcccagcccatgctgga
gggccaccaccactcaattgcactgcacatcagcacagcaccagttctcttacatgtgtccctctgaggaaaagagctggacttct
aagcacccttagtgtactcacctaaaatgaaactgaaacccataaaagtctcagaaatacccagaaactgttcatccatagtatat
ggcatcaactttagctatatacttttcatagatagtttcaatgagtttctatcacttgcaccggtcacttgcacctaagccttcccagag
gaaaaccaaaccttttgaaacagaaagtacttccaaccacaaaatctttgatgcatcattcattttctagtgactcaggagattcacca
actctgcctctttctataaccacttgcacaaaccacagcatttgcatatttgtgagtttatttttaagccagtgccttggctctggcagct
ctggttgggcatcaacatcctcttcacattttcttttcctctcttgaggaggatgtgggcagcatgtgcagcgcagtggtgcaccaat
gggataaagctgggcccagtgacctcgaaggacaacatcagcgagagtaaggccatcaaaacagacaggcctgaattggag
gggctgcactaaaactggatgacaggcaagaacattatttggtgggttcttgtggcaggttgacatgacattggccaagaccttga
ccaacaatggcacagctactggatatcccttggaagaggtgaggaggacacacagacaccatctacactctgtgacccacagc
aggcagcagggctcagccacacatgagcgggcatgggccgctgcttgggctgtttctgcacggccatgtatcactgcaggtatt
tccccggtggggacctcaggaatcaactgatcgtcctcaggaagtcgctctgtgttcacttacagtcctccccagcagtaagtgggt
gctcaggctcctcacagccttttttttttttttttggttggttttgttttctttgtccaactttggctgtggcagtacatccttggtctgcctaac
cacactgaaatgtactcatgcacctttccctgatttgcagaaagaaggttgtatggtctgaatgctctgtgctgttgcaagtctcttct
ggttcttcgaaatctgcagagtccctcccgactgtgtccttggtactgaacatccttgttcaccgtgtcagaaggcagctgggggg
ctggaggcagtagtgcgtggcaccaggatcccctggggcatttcttgcctgcggcgcctgggtgctccacgtggctgccaggg
ggacacacctcctgtagcagcccccagcaccaccatcctgctgtgtccattccgtcaccttgatcctactgtgtccagcccatcgt
ctccttctgctttgcctgtcagaagaacacttccatcccatcacttctgacccacccctcatcctgccgcctccacaggacccag
aactgcccctgccacgaagtgggaggttttgcattgctccgtatcactgtgtggtatatttggggccgggacaaccctgaccgtc
ctaggtgagtcgctgacctcgtctcggtctttcttcccccatcgtgaaattgtgacattttgtcgatttttggtgatttgggggttttctt
ggacttggcggcaggctggggtctgccaccggcgcagggccgggcactcagcgcggcagcctgggctgagtcttgtcccca
ccgagccggagggctccggtgtgcgccatggaggacttaggggttatttgtcaatggaaagttcttaaaatttgaccagaaaatgt
gcccgaggtctgtctctgccacacgatttcagaaattgtgtctaggtcgatgagaagacagttttgtctttgtcaggaaattagttgt
gagttgttagtccttccctcttagtcctaaggactaagacctttgtccccggtctggtctctcactggggactcttggctccagtgcc
atggggagcccaagtgtcactgacacggtgtccttgggggtgaaattcagttttcagctgtccaggtaagtgctgtcaaaaaatg
gaggttattctgctgaaaaagctgagaggaatattttgtcattttttcggaaatatatatatatatatatatataaatatataaattatttat
atattttatatatatatatataaaatatatgtatttctctcttctttttatatatatatataaatatatatatatttctccctcttctttatatata
tttataggagagaatctatatttttggccaatttggccaatttctctctctctctcttatatatatatatatatatatgtaatttatatatat
atatataaatttatatttatttatttatttatttatatagattatttttatatacatatatatataaatttggccaatttagaagaaattggcca
aaaaaacccaatctgaaccaaattacttagggcataagtccaaaaaaaaagtgcagttcaagaattcctcgctggaaagttttaat
gggggcagttcttcccccattttctggtgtagatatgagtgaagatatagatatgtatgtagatatagatttggctatagtttgtttgatga
acagtctgaggaagagtaaatcttgccttcctcatggcaattttaattctacttcttctgagacaagtctgaacatgccttgaggtag
aaagagcccgaaaattgagtgcttttcttttgaaattttaattaaaattaaaaaatagccttacagcaggaaagaaaggggggtgatg
gcagctaatcggagttccaaagctgaaccacgttcacccaaacacgtggttgaaattttgtgtgtgtatatatataaatatatatatgt
atacaaaagaaaatgcctatatataaaaaaattgttatgtatattatatagatttattatagatatgtacataagatataacacgtataca
tatatatgtagtctgctgtatgctttgtataaatttttatagatatgatgtatattatatgcatgggttatatatctataatatattttatctgta
gaaggaactacagtataaaatgcatatatgcgtatatatacacatatttatatatgtgtatatatatgtatacgcacacgtataacat
ccatgaaaatagatatggatgggtggatgtgtttgttttacagaggtgcatgtgtgtctgtacatacacagccatacatacgcgtgtg
gccgctctgcctctctcttgcaggccagcccaaggtggcccccaccatcaccctcttcccaccgtcaaaggaggagctgaacg
aagccaccaaggccaccctggtgtgcctgataaacgacttctaccccagcccagtgactgtggattgggtgatcgatggctcca
cccgctctggcgagaccacagcaccacagcggcagagcaacagccagtatatggccagcagctacctgtcactgtctgccag

Figure 9b Seq ID 186 (con't)

cgactggtcaagccacgagacctacacctgcagggtcacacacaacggcacctctatcacgaagaccctgaagaggtccgag
tgctaatagtcccactggggatgcaatgtgaggacagtggttcctcaccctccctgtccctctgggccgctgctggtggcagcag
ccctcacttcccactcagatgtcccccaccgtgcccccatcacccacctctgcctgtcgactcctcttgccctcatctctccaggtg
tcacattaataaacacgacactgaactagtgctgactctgcatccatgtctctgtgtccttttgcgtgctgtctgcatctcacacaggg
gggtcggccccagtatggggaagggctggggggcgcatacacacatattggtaatgttggggacgggggggggggggtgg
gggggtcaacagatcagcactggagacactggtgtataccctggcaccaccaacatctaaggcagggtgctttggggcaattt
ggggcagtttaaggtctgtgctggcactgagcacgtggctgtggccgtgctgtcctcatctcccacccactacggtctgtgcgcc
aggtccctagcagagatttgctttatgctgggaacaggggggagttctggctctgttcccttgcattcagacaccctggtgccccct
gggtgggatgtcagtgtgaatactcctttgtgccctgtgcctgcagcagcctgaccctccacacaccacacgccttgtgtgcacc
ccacccctgtcactatccctctccccgctccccagggagattttgcagtggcccctgtagggcagcttttagcacagcccccagc
agcaagcaagcagaaagcactgctgtgcacagcttgtcagctgtgtgtgtttgctgaggaggatctgtcttttgctgaggccatca
gtcttgtcctgctcaacctccatcgatgctgcccacctcaacacatctacccatctattccatctacaccaacatctccattcatccca
cccacccaaacatgtccatccatcacaacacctccatccaacccgcacactccagcacctccaatcattccatctacaccaccat
gctgatctgctacagccactccaacgcaaccgtccattccatctacaccaatgtccatccatcccagccactccagcacctccag
ccatcccacccaccctatgtctccatccagccactggtggggtgcaggacatggggccagctctactgtcaggactggggttttt
gcatggccccataccacttctgcagaagagacgcactgaaagtttggctgaccattttctccacggtagagttgtggcagttctgt
aatttaggtctttatccagtttggagatgggctgggatctcccagctccatggcaggcattcatgacactgggtttagtatctgat
gggtgggatgtggctgaacttcattttctttccccagtgacaaagtttttgcagttgaatatgaattcctgctttctgctctatgagttgtt
tttttcccaggacgtacacagggaatcagcagtcttcattctccctctgccatgtgtagactctctgccacacaggactgtgctgtcc
tcatgcccctgcgcccaaattgctgccctctgcccatgcctgccaagctgagccctgcaggctgccatgctggattgacatgagc
cctgagattggtacagaaatggtgattttggggttttctttgcactcaggaagctgaaggctcaatgctcagtgatggatttaccaaa
ctgtgccctgaggcagctgctcatgctggataaagtcactggagcacagggaaccaggcgctgggcagggatttctcatgggc
cccacttggaaagctgcaggctgcaaacctggctctgccttcacgcctcaccctcatgaggacaacctcactaattattgattaaa
agattttgctaaaccatctccagaagcaacaacccactgaggagcatgtgctgaattatacatcacagctccacggccctgccct
catagcagggctgcatggcacccacagtggcactcagagggaccacagggctgagacagccgggtctggtggtggggaca
cagctgagcataggatgagcccccgggcagtgctgggctttgctaatgagcagaagtatggatagaaagcaacccccagggc
tccgtacccagctgcagctcttgctctgtcgtgtcctttggtgaaactttaaacagtcgccttttttttctctttctttctggcttgccatt
aatttcaaaccgagagagacctaatttagtaaatgagatgcttcaggaaggctttaattagctgcagatggaggcaggcagtgcta
tcgtggggcctggatcgcacagggggctgcatatcctcactagcagaatacactcaggctgggtccctcccacattcatgcccc
agaccagagggaatatgctctgttccccacacatcgctcccaatcttgcagccgttgagccccaacatcccaccagcacacggg
gctcagcacgcctggcgacatggcatcagcagagcaggccgcatggtacagctccatcagcacagctggggccacacaaag
agctgggttactgtgggcagcaggctgaaacccgaaaacaagagctgggggctcagaatagccccgggagcaggcagggc
ctgggggtgagggcaagcaccaggcccagggccacacagcccttccaggaaggcacagcgctgtcagggtgcagcacgct
cagccccaccatgcagctgtgcggccggggcatcccaagctaaatttacttctcagtctccaatcagaaactgaagctgaggg
gcccacaccggccaaaaaaggaaacgaaacagtctccagaaagcactgacgtgtgaagcagagcgagcgccgcgcaaac
cggccgccatgtcacacacctcaggttggggctttgccagactgagctttgctgctgctcggggtgggtgcccacggcctgggc
acatgggatggggtacacacgtacacacacttgcacacccacacccccaacacttcaggtgatgctggtgcagatgggtgcccc
ccaggctgacccccccacgcatgggcctggccccacactgctccatccgtgtctctgtccccatgtgccaccccctgcccgctcc
caccacgcgtcaccccaaatcctgagttaatcccacgactcctgcctgcttccagcgtccatggcagactggagatgcccaaat
gcagagcaggtttccctgaatctgagagatgaaatggagttatgggtgttccccctgcggcggagccccagctgtaggaagctca
gagccatcacacagcaattaaagaggaattaaattaaatcaataaatgttttaggcgggctcagctgccagcaccacctgaccga
aacagcccgcttgcaaagaggagagcatttgcatggctgtggcaaaacagcaaccgcctgttgtgcagctgggatggtgttatc
tggaaatgtacgcagcccaggagggtaaacagctccaaactgagaccccgaacttgtccacaggttgtaaacaggctgacat
aaacacctttgtgccgtggaaaaatatttatcacctcaaatatagcaggttaataaaataaaactcccaacggagctacacacctgc

Figure 9b Seq ID 186 (con't)

tttggaagggaagcagacacttgttttctgcttgatgttggctgtaggaagccatgtttcccgatgcaggagggccacaaagcact
gacaacacaatgtgagctgagcttcgcccctgtttaagcccccacctcagggcttgtggtctcggagcaggcaggacgcaggg
gtggcaccgggctgggtgacatgggctggtcctggggtgtctcactgagctctttggggaggggttggagccctggggcaatc
acagcacacacagaggaggtgggggggatgcagccagcagctgccctgcactaagaaaaccccatccgtgggctttcagatg
gccttcccatctctctgcagcctctgcatgggctgaacacaaggtttaagtgtttctgccatgtttttggggcatgtttggaggggca
gcgtgggcccgggcatacgggtactgccacgtgccgccagccccacagctgagcctgcactctcccagatgtgctgaccgca
gccacgggggcaacagtttctcttgctaaaaattgtagccgggaagaaaacacgtggcaacttcggccaaacagcagctggag
gacaggaatagccgtggccacggcacgctctgcttcctcggcacaaacattccagtacgtggcaccacgagcgccgctgccc
ggcacagcagcaagcagagccaggagcaggaaatgctgatttgggcccccattttggccatggctgagagaagaggcttccag
ggagctggtcagcttggtccccaagctgtggcttggggaaatgatggggaggggattgccactgcccaccctgcagagcagg
ctctggtcccatctcactgcagggcaccagggcgtttgcactgcagcaattcacagaaacattgaaatggctcctgccttgttcaa
catcttcatcagtgacctggatgaggggacagcatccaccatcagcgggttcactgatcatatgaagtcgggaggagtggctga
cgcaccacaaggctgtgctgccattcaacaggacgtggacagactggagagctggacagggaggaacccaatgaggttcaa
caatggcaagtgtaggatctacacctgggaaggaataacagcatgcatcagttcaggttaggggctgagctgctgcagatgagc
tctgagagaaggacctgagcatcctgctggacagcaggctggctgtgagccaccggtgtgccctggtggccaagaaggccag
tggtatcctggggagcaccgcaatgagagtgggcagcagggcgagggaggtgaggctgcatttggagcaccgtgcccagttc
tgggctcctcagttcaaggcagacagggaactgctggagagagcccagcagaggggctgcaatgatgatgaaggtcctggag
catcgcctgtatgaggaaaggctgagggacctggattgttcagcttggagaagagaagactacagggcaggagccaagtgg
atagggccgggctcttccagcagtgcccagtgacaggacaaggggcagcaggcacaaagtggaacataagaagttccatct
gaacatgaggaaaaactgcctcgctttgagggtgtctgagcactggaagaagctgcccagagaggtggtggagtctcctctgg
agatattcagagcctggcaggacactttttgctgagtaacctactgtagggaacctgacgcagcagaggggtcggactggagg
atctccggaggtctctttcaaccoctacagttccatgaaatacctcaaacactgccaagcgcagtgctaaggcaagggtaacattt
gtaaactgaaacagggtgggtttaagttagatgtaaagaagaaactcttcactcagagggtggcgaggccctggcacaggctgc
ccatggaggctgcgggtgccccatccctggcagtgcccaaggcaagagcccagcagtgaccacagccccacaaggacgag
cgtggcccctcgtatctcagctcaccctgccccagctcaactccacctccggcacagcgcgggcacacagccgggccctgtg
cttatggagcccttggggcaggtcagcactcacaccctccaaacacagccgtggctcccaaccggaggcagctggatctcggc
agccataaccaagcagggccatgcgggggtgacaccggggtcccccaccccctgtggggcagcgtatgggctgggcccctg
ctccagtctgcagcgtgtgcatgggaaccatcaccagacaccatctagaccacctgcagccctaagctgcctcacagcaggga
ttgctccgtcacaccgtgaccccgtgcccttattccatcacttacggggctgggagtgcctggaccttgggcacattaacgaggat
ttcccgctctgccctcgctttgctccgagccgtggggctgtgtagtgcagacacagctgcagcctaaaattagcacctgggaaag
gcccccatgctgcaccgcgcagggctgagatgtgccacgtccccatggccggagctggggaaggcaacgtggccctgtgcg
tgtgcacgctgagcacaaggacacgtgctgggccaggatttgtctccccggggctcacgctatgtgtcaccccgtgctgtgcca
tccctcccgcagcccccagctcccccacggccgcacgccgcctgcatccctgcaacggcaccgcacagagacacggagcc
aggggccgcacacggggccaggagctcacctttattgcagccctgacagccccacggcccagcccatagcggggctgccac
atcctcacccggccgacggccccagctgctccttaccatttcttcccccatcacccataaaccagaagccgcctcaccgctacgc
ggagcgggcagcagggaacccgggccctaaggggggagacgagaggggggccgagcaggggcaggaggagcagcaggg
cgagggggcagcgggggcacccacagctggccgtggcatcccgggaggagaagaccttgcggctgcgggagcggttgtgg
cggacggaaattgttggtcatcttcaggggcgcagcgcccgaggccgggaagtgcacggtgctgacaaacgcctgcagctgc
gggagagcaccgcgggcgccgcagccgtgaggcgtagggcgaagcggggcacacgcgtggctgctgccgggcagagc
gcagcgcaggagccccgtctttccccctaccggcagcacacggctctgcacacaccgcgcttcgtgccgcctcgcagccgac
gctgcaggaagcccagccgagcgcttacagagcggccgggaaatgcatctgctgaggtgcccgggcaatgcagaacttcatc
catccccacatccattcaccagtcccctcccaaacccccatgcccatccggcgacccacccaccctcctcttggtgcccctctca
agctctccatccccacattcctacagatgtcccctttactttgcctgcaaggtgcaagaaaacgcacagggaccgggggtgctca
cagcacggctttggccagacgggcccttccatcccatggcagcagggccgaggaatcccattacctgctccctgctgatgccc

Figure 9b Seq ID 186 (con't)

acaggctcctcaaacacggtccagatgacggcctcgctgcagtcagggttgtcagggagccctggtagcggtagtaccggg
acagctgtgcaacgtgcggcagcagcgtgccaaggcggaaggtggaggccaggtccactgcctgccctgcacagcaggac
atgggcactcagccccgctgcccctggcacgccccagggtctctccctcccagccgtgccccattgcagagcaccagggca
cctcaccagcatgggagatgttcctcagtcccccaatgatggtgttgtagttggagtttggggcttctgagacctgcaaagagcga
gtgggccctgcagctgtgctcatttaaggccaacgcatggcagcacccatcccatgcactttgcagccaacctggaagaagca
gcccagcacagccagcccgcttgggtgccccttggcctcccccagggtgcggtacttgacgttgatgtggacgatgtgcagct
ggagaaagaaagcacggagggctcagcagaggcacccggcctcgccagcagccaggcaccaggatgggaaatcaaagg
gccgtggtgctaaggggcttcttgcctacctccatggggagctgctgcccatccacggtgtgctcagagccattcgtagacagg
ctgccccagtggaagtgcagctgcagtgcacggtagcggcccgggaggcccccgccactgatggcaatgtgctcagcaccc
ggctcgctctccaggctcagcatcactgcaaacgataggagtgggacaggactgggggccgtggggcagcactgctgcaga
gctgagccctggctggagcagaacacccacccgtgtgcccatcgttcagcagccgccacttgccgggggggtgcctggtcata
gccctcaaagatgatgtccccaaggctgccgtcccgctgcagccagcgccggtcgatgttaaccggagactgcttgtcaccgc
cgcaggtggccttcagctccttccagtggctggggcctgcggggagcacggccatgggggcacccgcagagccaccagcac
cacccccagggggggacacagagccaagggcagccctgtccccaccacggaccctgccccatctccagcccttctctccccgt
tactccaggaaggttttacttggaaacctgtggagctgtaacccgccccgtgagctccccattacccaccgccttcattaagggat
ggtgccctcagcacgtgcctgttctgtgctgccccaaccgcccccgccagccccagcacggtttaattgctgctggagccggc
tctgtgccgggcagtgaggctctgagcgctgctggacgcagctgacctgcagcacagtgagcacgcacctgagggctataaa
gcaattgggctgtaactgctgattacatgctccctgatccttaattaacctcttacaagctattatacgtgcgtttccaaagtgccccc
gggcactggggagggaggcaccgaacagagctgtgaccgtccccactcaccgcacttcgggtcctgcgagtcgtagcacca
ctgccctgcgggagagagctgtagtcaggggctgcagaggcccccaaagccccccatactgcggatctctgcacagcacac
agcgtgaccgtgggcagaggtgcgcccacaccgcccggagcagcgctacgcggagccgcttccctcccacctcgctgctgt
cagtgcagggacacacagctctgctgtgttgggagcggggtgaggagcgcggctgctgcccacggccgctctgctccgctca
tgtcccaccaacccatccaaatccccgtgtgggaactcagccaccccagcactccctgcctacagggatggttccccgctgacc
ccgtgctctctccagccacaggccgcaggcagcgctgcgtgcaccgcctgtgctgctggcttcgcatccatgtcctcaccacgc
tgctatgtgaggctgcagccacagggctgggaacagggactgtcccagggcagtgacttcaggctttccttcccatccagcgg
gaactgagcctcctgcacaccctcagagccacaaagcgctgccctcacccaactgtgagcatccctggcgtgagccaggtgg
gcgctctgctctatagaagggtgctgcgcactccagccccatttgctctgaggtgtcgtcctcagtggcatttccctgcttatgagt
acatggggcagaggggctgaaacctcaatcccagctgcctgattgaccgtccgacatcccagacacctcccagcagggctga
cacctccctgagcccggcagcacggcggggacaggggtgtcccacggggagggcacagaacacagctcctgggctgcacc
acatctccgagcgccacagacatgcattccccccaacatgtgggaaagggaatagagtgctggcactgccgtacccccctccc
ggcaccatgctaccccataaccccaagccacctgcactccgtgcccatccctccgcagccccaaccacgacggtgcagcag
acgggcagcgcat

Figure 12a Unit1 Seq ID 187 gcgatcgcataacttcgtataatgtatgctatacgaagttatagaggatcctattaattgtttgttaattaagaggacaggaattcagt
gtcaggggggctgctctttgcttcccaatgtgtaccactgaagcctctctggatttatcagagatactcaatggactcttaacagcact
gtggcacctgacctcctgctgccttcagcctcccttcctggctggtgtgcttgtgttgaggagctgtgggaggctggtgcagttctg
tgggatgaggtaaggccagctgaatagcctgggggctggtcaggggggcttagtgagaggagcagggctggggaatattgtga
acagcaggtggtgccactgctattctgaggaaggaggcagcttctgcaaatgctttgcaatgcaggatgacaaagtgcttctgct
agctctaggcccttgctcatggctgtgatggtgcttaacggtgccagagtgcagtgccagatatgacatgcagatgacccagtct
ccatcctcgctgtcttcctgtctaggtgagagtcaccatcacatgccaggaaagtcaggcagggcattagccatgttttagcctgat
acaaagagaagccagggaaagcttctgagctcctgatctacgatgcatccaatttgcaaacctgggtcccattgcagttatgtgg
cattggatccaggacagatttgattctcaccattagcatcctccagtctgaagttgctgcaacttcttattattggtcaacagtataaaa
gtgaccctctgtacactttggccaggggaccaagctggagatcaaactaccagcagaagacctctggcagtgcatctgtcgct
gtgctgaaaccaacagacacaccaacaccacaggacagcttcttgcagttctccatctcctggtgcagcttcatgagcacgttaa
ccatcgtggggattcaagctgaggatgtagctgtctatccctgtggcaacagggacagcagtggtaagcctggtgaggtgatac
agggagatgtcaaaaaaaaagaaaaacccaacatgtatggggttaaaaatggaggctctctgcccttttctctcatggctgagct
gggctgtgcagtgaggtaagttcctgtctcgtctgcaaagcactgtctgaatggtctccctattgtgtgttgtggtgcatgagggatt
ctggggacagagggcatttgtctgtccctataaaggcccaaagcccctggctgtgtacagtaagtccgcctggggcacctgagc
tgtgggcaggtactgccaggagaggggctcaggccatgatccaataccaatggctctgtgtccccatgctaataggggctatgct
gcagcccatcactccctcttaaaccccctcttaaacttcctacagttctaagttctatctctctcctccaattaatcatcgtcaccatagt
ttgatatccactttggtcccagggccgaaagtgaacggagggggcattgtaagtccgttgaccgtaataagttgcaacatcttcagg
ctgcaggctgctgatagtgagagtgaaatctgtcccagatccactgccactgaaccgagatggggactccagattgcaaattggat
gcactatagatcaggagcttaggaactttccctggtttctgccgataccaatttaaataactgctaatgccctgactcacccggcaa
gtgatggtgactctgtctcctacagatgcagacaggggaggatggagactgggtcaactggatgtcacatctggcacgaggaga
gaggggagaaaatggagctcagtgagtgtgcgacacacacagccctcagcgtactgcggtgggataatacttctgagcacaca
gtcccaaatggaacctcaggactctctcatctgcttcaggatgaacaatgtgtgccagatgtgacatccagatgacccagtctcca
tccttcctgtctgcatctgtaggagacagagtcaccatcacttgccgggcaagtcagagcattagcagctatttaaattggtatcag
cagaaaccagggaaagcccctaagctcctgatctatgctgcatccagtttgcaaagtggggtcccatcaaggttcagtggcagt
ggatctgggacagatttcactctcaccatcagcagtctgcaacctgaagattttgcaacttattactgtcagtgtggttacagtacac
ctccgacttcggccctgggaccaaagtggatatcaaacaggcagcagtaatcctggtttggtgatacagggagatgtgcctccc
cccaaaaaaaccccaaacaaacaaaaagcatatataggggggtaaaaatggagtttttctgcccatctgtctcacagccaagctgg
gctgtgcagctgcggcaggttcctggcctctctgcaaagctctgtttgtgaatggccttccttcctcttgtaccttgtggtgcaggag
gagattgtggggacagaagccacttctccttgtccctacaaaggcacagcactgtgtcatcccccagccctcctccatgttactgct
ggcagtcccgtcctcctgcttctgaagagacatggatgtaggtgaggtctcttctgcaacagtggtgttcatcaccccacagctgc
caggtgagggctgtgtgtgtcggacatttggctgagctccatttctctcctgtccctctccaggtgccagatgtgccatccagttga
cccagtctccatcctccctgtctgcatctgtaggagacagagtcaccatcacttgccgggcaagtcagggcattagcagtgcttta
gcctgatatcagcagaaaccagggaaagctcctaagctcctgatctatgcctccagtttggaaagtggggtcccatcaaggt
tcagcggcagtggatctgggacagatttcactctcaccatcagcagcctgcagcctgaagattttgcaacttattactgtcaacagt
ttaataattaccctcacacgttcggccaagggaccaaggtggaaatcaaacagtgctgcctgcaccagggaactgggagagga
gaggggggagaaaatggagttcattgagtccctgatatacggagtccttgctaggcaatgagataagacagctgagcccacag
accatcttttacggaccagaagtgacatccagtcacccagtctccatccacactgtctgcatctgtaaggagacagtgtcaccatc
acttgccgggcgagtcagagcattggtagtaatttagactggtatcagcagaaaccagggaaggcccctaagggcctgatctat
gctgcatccagtttgcaatctggggctccttcgcggttcggtggcagtggatctgggacagattttactctcaccatcagaatcctg
cagcctaaagatgttgcaacttattactgtcaacagtataaaaattacccctatgacgttcggccaagggaccaaggtggaaatcaa
acactgtgatctatgctgacaccaacagacccaccaacaccacggggcagcttctcacaatcctcacgttctggtgcagcttca
tgagcacattagccattgtggggactcaagctgaggatgtggctgtctatttctgtggcagcagggacagcagaggtaagcctg
gtgaggtgatacagggagatgtcaaaaaaaaatgaaacaacatgtataggagttaaaaatggaggttttctgctctcttctctcaca

Figure 12a Unit1 Seq ID 187 (con't)

ggtgagctgggctgtgcagtgagatgagttcctgtccctctgcaaagcactgtctgaatggtctccctgctgtgtgttgtggtgca
tgaggagagtctgaagacagagggtacttctccctgtccctgagaagctgctgcatggtgtcatcccagccctgctgcatgtta
cactgtctgccctgtccttctgatgccgaagctgcttccatgctgggatgctctgggctgagctctgattctccaaaatggcagtgg
tttcttctgatggtggtggtattcctcattctactgctgtgcagggagggctgtgtgtgtgttggctacccactgagccctgttttctct
cctctccctctccagggaccagaagtgacatccagtcacccagtctccatccacactgtctgcatctgtaaggagacagcgtcac
catcacttgccgggcgagtcagagcattggtagtaatttagactggtatcagcagaaaccagggaaggcccctaagggcctgat
ctatgctgcatccagtttgcaatctggggctccttcgcggttcggtggcagtggatctgggacagattttactctcaccatcagaat
cctgcagcctaaagatgttgcaagttattactgtcaacagtataaaaattaccctatcactttcggccctgggaccaaagtggatatc
aaaccagtgaggggcattgaggctgggaacaatgcagtgctgtgcctttgcaggaacagggataacggggcactggacccag
aattgattactgaatgaaaaggttcagtaagagaggacatgcgtgtgatgtacagtctggcagaagggactggattctccctcag
ccctgactcaacaagggcagaaagccttggttttgaatcgcagtctgcatgtcaccccacatctccccacatcactatacgtttga
tctccagcttggtccctggctaaaatgggagggtactataatactgttgacagtaataagttgcaaaatcttcaggctgcagg
ctgctgatggtgagagtgtaatccgtcccagatccactgccgctgaaccttgatgggacccactttgcaaactggatgcataata
gatgaagagcttaggggcttttgctggttttgctgataccaggctaaataactgctaatgccctgactggcccagcaagtgatggt
gactctgtctcctacagatgcagacagggagaatggagactgggtcatccggatggcacatctggcacactttgggacctgagc
cagactgtacctgtccctacaaaggtacagcactatgtcatccccagccttgcttcatgttgctgctgcaagccctgttctcctgctg
gagctgtctctgtgctgggatgctctggtctggactctcatcttctaatgtgccggtggccatgactgaggtttcttctcctttaatagt
ggtgctccctttcccactgttgtacgcagagggctgtccatgtggggtattccctgagccccactttctctcctctccctctccaggt
gtcagatttgacatccagatgatccagtctccatctttcctgtctgcatctgtaggagacagagtcagtatcatttgctgggcaagtg
agggcattagcagtaatttagcctggtatctgcagaaaccagggaaatcccctaagctcttcctctatgatgcaaaagatttgcacc
ctggggtctcatcgaggttcagtggcaggggatctgggacggatttcactctcaccatcatcagcctgaagcctgaagattttgca
gcttattactgtaaacaggacttcagttaccctccccatttagccaggggaccaagctggagatcaaactagtgccaggggggag
atgaggcggtgaattgatggccagagctgaaaatgatgggtttccacccttctccattatgactttgttgagatctcttctcatgatg
gtcttccctggttttcctgtggttggaaggagcagaaggcactggcagggtcttgctgggagagctggcaatagcagggatag
tggatgccccacatggaagaaagggacacagctatggccacttctgatgagaggtgtccagagcacagcagcacatccctgtg
cttcagacatctcctgtgccctggggtgtggaagggaatgcattcatagcatggccaggtggaggtaagagtaacatgcctactg
cagtaattctgcacatagagaaggaagaaagacagaaaatcttcctacagttctaagtttcctctctcttctccaattaatcatcatca
ccatagtttgatatccactttggtcccagggccgaaagtctgagggtaattattaaactgttgacagtaataagttgcaaaatcttca
ggctgcaggctgctgatggtgagagtgaaatctgtcccagatccactgccgctgaaccttgatgggacccactttccaaactgg
aggcatcatagatcaggagcttaggagctttccctggtttctgctgataccaggctaaagcactgctaatgccctgacttgcccgg
caagtgatggtgactctgtctcctacagatgcagacagggaggatggagactgggtcaactggatggcacatctggcacctgg
agagggagaggagagaggggagaaaatggagctcagtgaatgtgtgacacacagccttcagcatgctgcagtgggactgag
caccagcacttgctcagctccatttctccaggtgccagatgtgacatccagatgacccagtctccatcctcactgtctgcatctgta
ggagacagagtcaccatcacttgtcgggcgagtcagggtattagcagctggttagcctggtatcagcagaaaccagagaaagc
ccctaagtccctgatctatgctgcatccagtttgcaaagtgg>cccatcaaggttcagcggcagtggatctgggacagatttca
ctctcaccatcagcagcctgcagcctgaagattttgcaacttattactgccaacagtataatagttaccctcccactttggccaggg
gaccaagttggagatcaaaccacagtgacacagagcaatggagatgtgatacacaaacctgtcagtgcagggaacagttggca
ctggcactcatctactcctggactcacaagtgccagatgtaacatccagatgacccagtctccatctgccatgtctgcatctgtagg
agacagagtcaccatcacttgtcgggcgaggcagggcattagcaattatttagcctggtttcagcagaaaccagggaaagtccc
taagcacctgatctatgctgcatccagtttgcaaagtgggtcccatcaaggttcagcggcagtggatctgggacagaattcactc
tcacaatcagcagcctgcagcctgaagattttgcaacttattactgtctacagcataatagttaccctcccactttcggcggaggga
ccaaggtggagatcaaaccactgatgctggtagtgacggggagatgtgaaactgaggtacagccctgaattaaaaacgtctgttt
tctgcctttctcccttatgtttgttctgggctgtgtcactgaggcagttttccctctgcatggccatggctttgatcatcttttctgtcctgc
ctcagtgtttggaaggtgactctcccagttaccgcggaggaaccatgaagatcatttgctcctggtgtagcagtagctatggttgtg

Figure 12a Unit1 Seq ID 187 (con't)

gctgcatctggcttcaacagcaagttaaccattactcatgttgaaaccaaggatgaggctgtctaagatgtgtgagctagcatagc
agtgaggctggtagagtgacaaagggaagcatagctgtgatgtctacttctggagtgcactggggcatgaaagcgaaaacagt
caaagccacaaccacacggagggaacaggaacatgtctacagccataactctgcgtggccaaaatgctgaaagtcagaaaac
cagcagggagcggggctgggtgcagtgcatgccaacccttgtggggacagctgtagaacatggaattcaatctcagtggagt
cgaaccaattggcaggctgtcagcagaggcattccccagtgctccccttgtttaatgtgaaattacaaacaacgctgccaggca
acaaactgtattgatctgcttgagggtaggaaggccttgtagacagatgaggataggcaaaaatcaatgggctgtgtcaaaccca
ttgacgttcaagaacgttaagtcccagggcctgcacttaggtcataacaacacaaggcagcagtgtaggctgaagagatggttg
attagagggttctgttagaatggttcaattctgtgatcatgaagataacttccaaacaaaattggtgtaggatagggataaggtgctc
tggccccagaatcacctgcaacaaaaaatacagcagggagggcataaacaattgcggccctgcagaggggcagggcatctg
cctcagtttgatctccaccttggtccctggccgaacgccggagggtaactataatactgttgacagtaataagttgcaaaatcttc
agactgcaggcagctgatggtgagagtgaaatctgtcccagatccactgccgctgaaccttgatgggaccccactttgcaaagt
ggatgcagcatagatcaggagcttagggcttccctggttttgctgataccaggctaaataactgctaatacctgactcgccc
gacaagtgatggtgactctgtctcctgtagatgcagagaatgaggatggagactgggtcatccggatggcacatctggcacctg
gaggggagaggagagaaaatggagctcagtaagtgcctgacacgcaacacccagtgccagaagatagcactgatccccaa
gacaaggagaccatgcatgccaaagaggttcctctttctctcccacttcctctcagtccggctctagggtctcccctccttcctcctg
ctctccttcaccctgtacatcagatcccagggctttgctgcatttctgctcctgcaggcattgcctggggccctgtggcaagaccag
ttccagatgcgacatccagatgacccagtctccatcttctgtgtctgcatctgtaggagacagagtcaccatcacttgtcgggcga
gtcagggtattagcagctggttagcctggtatcagcagaaaccagggaaagcccctaagctcctgatctatgctgcatccagtttg
caaagtggggtcccatcaaggttcagcggcagtggatctgggacagatttcactctcactatcagcagcctgcagcctgaagatt
ttgcaacttactattgtcaacaggctaacagtttccctcccactttcggccctgggaccagggtggacatcaagcccgcagtgcca
ccaccagcatatcgtttgatatctactttggtcccagggccgaaagtgagagggtcactttatactgttgaccaataataagaagtt
gcagcaacttcagactggaggatgctaatggtgagaatcaaatctgtcctggatccaatgccacataactgcaatgggacccag
gtttgcaaattggatgcatcgtagatcaggagctcagaagctttccctggcttctctttgtatcaggctaaaacatggctaatgccct
acctgactttcctggcatgtgatggtgactctcacctagacaggaagacagcgaggatggagactgggtcatctgcatgtcatat
ctggcacctggagagggagaggagagaggggagaaaacggcaatcagtggctgcctgacatacacagcttcccccccgcaaa
gcagcaggacagaggccccatgcccatacaggcccaggtcacctgaactgttggtgaccatcactagtaggagaggggccca
gaccatggtgctactccaacagttgtgctatggaccccaactccctttagaccccccaccttctacagcacagccacctcctgca
agcctggtgtccatggatactggccaccccatccatgctcccttgcctcctgtagccattttccttgatctcagaagaccaatc
atggttagccattactgggatccaaaatgagcacaagactatctactactgcggtagcttgggaaacagcactgatactggtaga
atggcacagggagatgggaaactgagttacaaacctgagttcaaaatggaagctttctgcacttactgcattatggctggacagg
gctgcaggggctgagtcctgtttctgtcctctctgcacggccctgactgtaaatggcctcctctctcttcttaaccacaatgtacctgt
ccctgcccaggcacagcactacgtcaacccctagccctgctccatgttgctgctgtgagctccatctccttctagagctgcctttgt
gctgagatgctctgtgctgggctcttgcccacaaacataccctatgtctgtgactgaggacccttctcctctgatggtagtgcttcccc
tgcggttggggagggcagggcaaattgggcacctgttgagcccccatttactcccctctccctatgcaggtgccagatgtgccatc
cagatgacccagtctccatcctccctgtctgcatctgtaggagacagagtcaccatcacttgccgggcaagtcagggcattagaa
atgatttaggctggtatcagcagaaaccagggaaagcccctaagctcctgatctatgctgcatccagtttacaaagtggggtccc
atcaaggttcagcggcagtggatctggcacagatttcactctcaccatcagcagcctgcagcctgaagattttgcaacttattactg
tctacaagattacaattaccctccaacgtccggccaagggaccaaggtggaaatcaaacgtatggtgataggggcgatgtgg
ggggaaaaaaaaaaaaaaaaagacacatataggggataaaaatggaggttttctgcccatctgtctcacagccaagctgggct
gtgcagctgaggcaggttcctggcccctctgcaaagcactcgttgtgaatggtctccctcttgtacagtgcagtgcaggaagaga
taccaggtatgtccagacctgtttgctgttactgctggcagacctatcctcctgctttgaagaggcatggatgtctgtgaggcctcat
ctgccagggtggtgttcctcatcccaccccctgccaggtgagggctgtgcgtgtcaggcaaacactgagccccattttctccccctct
ccctctccagataccagatgtgacatccagatgacccagtctccatcctccctgtctgcatctgtaggagacagagtcaccatcac
ttgccgggcgagtcagggcattagcaattatttagcctggtatcagcagaaaccagggaaagttcctaagctcctgatctatgctg

Figure 12a Unit1 Seq ID 187 (con't)

catccactttgcaatcaggggtcccatctcggttcagtggcagtggatctgggacagatttcactctcaccatcagcagcctgcag
cctgaagatgttgcaacttattactgtcaaaagtataacagtgcccctctcactttcggcggagggaccaaggtggtgatcagtcc
cacagtgactcagatgtaatacacaaacctcccggcagtgcaaggagcagataatacccttaactgtctgtcttacaggttccacc
tccatcaatacccatgctgcagggctcaggtcctcttaggctgccaggctgcaccctgctggctccctccccactaccctacac
ccacccttgcagtgtccctgcatgcactggggcaacacttcctcacctgtccgctccctgctggagggccacagccacctggt
tgatacatcagcatagcaccagttcttccccaagctggccctcccttggactctctactgagccccattttctcccctctcctctcca
ggtgccagatgtgccatccagttgacccagtctccatcctccctgtctgcatctgtaggagacagagtcaccatcacttgccggg
caagtcagggcattagcagtgctttagcctggtatcagcagaaaccagggaaagctcctaagctcctgatctatgatgcctccag
tttggaaagtggggtcccatcaaggttcagcggcagtggatctgggacagatttcactctcaccatcagcagcctgcagcctgaa
gattttgcaacttattactgtcaacagtttaatagttaccctcacaccttcggccaagggacacgactggagattaaacccatggtg
acacacagcagtgaggaagcgatgcacaaacctcctgacagtgcaaggagcagccggc

Figure 12b Unit2 Seq Id 188 gccggcaggttttgctgtctctgtttgatggtggcacaggacctcaccacagccctaccttcactgtcctgcaatatgggtggctgt
gcacggtgtcctgaacacgtcccaacaagatgcacagcac.gcatcaggcccagcccctgcctgtagcagctgatgcccttgtc
cagcttctgcctgagctgcctctgtgctgggatgctccatgctgagctctgatcctccaaagtgcccatagctgtggctgggatcc
cttctgctctgatggtggtggcacattgcaggaacagagcccagaccagaacagctcagtacagagccagctccagcaggga
gagaatggggctgccagcagcaatgtggaacagctggggatggcacagagctgtgccttttcagggacaggtacagtgtgact
cagtacccagagtaacctctcatacaactacatataccaaggaaggcatttacaagcatggccatgcagagaagatataaatcat
cctcagtctcacagacctgctcagccataaggcatcaagggtgaaaaacctctatttttttttaaccctgatcaatccatcagttcctc
acctcccgctgaggcaatacggttggcgtccaccctggtcccttggccgaacgtcggatggctgctgtaagtctatagacagca
ataagttataacatcttcaggttgcaggctcctgatggtgagaatgtgtgaaatgtgtcccagacctactgccactgaaccgtgac
gggaccccagattgcaaactggatgcagcatagatcaggagcttaggaggattctctagtttctactgatactagcttaaataattg
caaatgccctgactcgcccagcaagtgatggtgactctctctcctacagatgcagtcagggaggatggagactgagtcatctgg
aaattacatctgactcctggagagggagagaaaacagggctctgtgtgtgtctgacacgcacagcctccttgtttggcagtgggg
tgaggctgctgagcacacagacacacatgggacagcaggagacccacatctgctccaggattgacatctatggctggtaccag
cagaagatacctggcaatgccccatcactgggatccatgctaacactggtagacccacaggcgttctcttaccattctctggggtc
caatccaggcctacacacatgaactgtcacactaactaccactgtggtctaagctgtggagaacactgcccattactgcggtggc
aatgacaggagccaaggcctgaggatggcacttatcaccaggatagcaggacaaggggttcacaagaaaaaaagaaaggttc
tttttcctctcccgcttcctctcagtccagctctgtggtctcttctccttcctactgctctccttcaccctgtacatcagatcccagggct
tcgctgcatttctgctcctgcaggcattgcctggggccctgtggcaagaccagtgccagatgtgacatccagatgacccagtctc
catcctcactgtctgcatctgtaggagacagagtcaccatcacttgtcgggcgagtcagggcattagcaattatttagcctggtttc
agcagaaaccagggaaagcccctaagtccctgatctatgctgcatccagtttgcaaagtggggtcccatcaaggttcagcggca
gtggatctgggacagatttcactctcaccatcagcagcctgcagcctgaagattttgcaacttattactgccaacagtataatagtta
ccctctcactttcggcggagggaccaaggtggagattaaagtattttgacaatgtgtagtaggaacataaacacagccacattcac
agtaaagttttcaggccaccttccttggtccccgagctttgggaattgtgacttatgttactgttttgggaattcaggaggccttgtcct
atctgaatggccaagaccttgactgttaccccagatcatattccaggaatgagggtgatactgggtatagaccccatcatccttgtc
cctctccaggagtcagatgtgatttccagatgactcagtctccatcctccctgactgcatctgtaggagagagagtcaccatcactt
gctgggcgagtcagggcatttgcaattatttaagctagtatcagtagaaactagagaatcctcctaagctcctgatctatgctgcat
ccagtttgcaatctggggtcccgtcacggttcagtggcagtaggtctgggacacatttcacacattctcaccatcaggagcctgca
acctgaagatgttataacttattactgtctatagacttacagcagccatcccacttttggccaggggaccaagctggagatcaaact
atggtgacaatgattaaaaggaactgaattaataaattataagcctgttttctgcccatcttccttttggccatgcagaactgtggcca
tagcagtttcctgttccatctgcatggccatgctatgaatgcactccttccacaccgcagggcacaggagatgtctgaagcacag
ggatgtgctgctgtgctctggacacctctcatcagaagtggccatagctgtgtccctttcttccatgtggggcatccactatccctgc
tattgccagcactcccagcaagaccctgccagtgccttctgctccttctaaccacagcagtgggtgctgccccagagctgctc
ctctggatgctgtgccccacatttcctgaacacacactgcccatccagcaatgtgggacagggaacaccacagcaggaagaga
cctcaatcacagccatagtggaggcagacagaaacctgtcattttagctctagacatcacatcactcccatatctccctgtgtctct
gtacctacaaaactgctgtcataggccccactaggacaggaacatgaatggggctctgcaaaggcagcgccacagcagctgtg
gacccagagagcagaactgactgccctcaacagctccgcccatgcagggagatgtgcagcaacaaggaggggaggaaatc
caacagtgccgccaccagtttgagatcgaccttggtccctccgccaaaagtgagagggtaactattatgctgtagacagtaataa
gttgcaaaatcttcaggctgcaggctgctgattgtgagagtgaattctgtcccagatccactgccgctgaaccttgatgggacccc
actttgcaaactggatgcagcatagatcaggcgcttaggggctttccctggtttctgctgataccagcctaaatcatttctaatgccc
tgacttgcccggcaagtgatggtgactctgtctcctacagatgcagacagggaggatggagactgggtcatctggatgtcacac
ctggcacctggagagggagaggagagaaaatggggctcagtgcctgacacacactgccctcctcctcctcatggggagg
agacccagagcacacaagcacacacagaatattcaaacaccgacttctaatccatgcttaacagcaactatgactggtacaag
cagaagactcctgacaataccactggcactttgtaatacctccacaataagcccccctctctcctctccctctccaggtgccagatg
tgacatccagatgacccagtctccatcctccctgtctgcatctgtaggagacagagtcaccatcacttgccaggcgagtcaggac

Figure 12b Unit2 Seq Id 188 (con't)

attagcaactatttaaattggtatcagcagaaaccagggaaagcccctaagctcctgatctacgatgcatccaatttggaaacagg
ggtcccatcaaggttcagtggaagtggatctgggacagattttactttcaccatcagcagcctgcagcctgaagatattgcaacat
attactgtcaacagtatgataatctccctctcactttcggcggcgggaccaaggtggatctcaaacttagtgacggggggagat
gtgaaactctctacagccctgaattaaaacatggatgtttctgcctttctccctcaggatcacgctgggctctgtcactcaggcagg
ttcccctctgcatggccacggctttgaacatctttcctgttctgcctcattgtataggactctcccagtacctggaaacaccaaaaata
ccagatgtgacatccagatgacccagtctccatcctccctgtctgcatctgtaggagacagagtcaccatcacttgccgggcgag
tcagggcattagcaattatttagcctggtatcagcagaaaccagggaaagttcctaagctcctgatctatgctgcatccgctttgca
atcaggggtcccatctcggttcagtggcagtggatctgggacagatttcactctcaccatcagcagcctgcagcctgaagatgt
tgcaacttattactgtcaaaagtataacagtgcccctcccacctttggccaggggaccaacctggagaccaggcaaatgcagac
aacagttgtacagtactgcttcccactgacacagagcagcaggtacaactgatgcactaacctcctgccagtgcagggagcagc
tggctcttttgctggctctgtttgatggcggtgctggttcctaccatggcccttccctcattgccctggactacatgtggcagggca
aaaatcacatccccagcactgacagcagggaacctgtggaccgctgagcagccaggccaaagctccctacttagaggggatg
ttttcccatggcacaaggctgggctggctgtgtttctcttctggcacgagggcagccacagaatctttcagatcaggatgattgttgt
gatctgctcctacctcagctcaactggcatcacctacagcacagtgcccaggcctgtgtgcaggtggctgtcagagatctccaag
gaggagactccatgatctctccgggcagcctggatcagtgctacattacctgcggagtaaggatgtgactcctgactctggccag
acagaacctctgcgttcagtctgtgccactgcctcctgtactggtgctgaatgctgctggaaaaagcctggctctgttcactttgca
ccctcctttcaggttagcgtaagggagaggagagaaaatagggctcagcaattgcccaacatgcacagccctccaccaggctgt
cagatgaggcacgcaattccacaaggacacatggggtagcaggataccgttccagatgcgacatccagatgacccagtctcca
tcttccgtgtctgcatctgtaggagacagagtcaccatcacttgtcgggcgagtcagggtattagcagctggttagcctggtatca
gcagaaaccagggaaagcccctaagctcctgatctatgctgcatccagtttgcaaagtggggtcccatcaaggttcagcggcag
tggatctgggacagatttcactctcaccatcagcagcctgcagcctgaagattttgcaacttactattgtcaacaggctaacagtttc
cctctcactttcggcggcgggaccagggtcgatctccgaccatggtgacacacagcagtgaggaagtgatgcacaaacctcct
gtccgtgcaaggagcagctggcaggttttgctgtctctgtttgatggtggcacaggaccccaccacagccctaccttcactgacct
gcaacatgggtggctgtgcacggtgtcctgaacacgtcccaacaagatgcacagcactgcatcaggcccagcccctgcctgta
gcagctgatgcccttgtccaacttctgccagagctgcctctgtgctgggatgctccatgctgagctctgatcctccaaagtgcccat
agctgtggctgggatcccttctgctctgatggtggttgcacattgcaggaacagagcccagaccagaacatcttagtaaggagg
cagctccagcagcagcagaacggggctgccagcagcagggaatgatgctgtgccacagtaggaacagggaccaagaggat
cacttcccacgcaataaagtataaaagagagggcattcaaaaacacagccatgcagagcagagagaaacctgactcagcccc
acagtcctgctcagccttaagtcagcaagtgcagaaaacctccatttcaactcaggtctgtaactcagttccacatcctctttgtctc
tataccagcattagtgctgctatcccagccaccacagcctcatcttctgaccttagtgacaactaaccacaattggtcttccagggc
ccagggaaatagctgcactgggacaggagctgccagtgaccatgaggttctgcatgagtgggctgtgttgtgggcagttcagg
gtataaagaaaggagttggagtccatggcatagacccattggcataaggatgtgcatctgctgggatcacaccatggcctgtgcc
cctctcctgctggcagtgctgacccacagctcaggtgccccaggaacacccgttgtgcccagcctttgggcactgggcccatc
cccctgcttttttaagacttggcatcaattcaccacaacacctctctgcagcaccagtttgatgtccagcttggtccccgggccaaa
agactccggagggtaactattaagctgttgacagtaataagttgcaaaatcttcaggctgcaggctgctgattgtgagagtgaattc
tgtcccagatccactgccgctgaaccttgatgggacccccactttgcaaagtggatgcagcatagatcaggagcttaggggctttc
cctggttttttgctgataccaggctaaataactgctaatgccctgactggcccggcaagtgatggtgactctgtctcctacagatgca
gacaggaaggatggagactgggtcaactggatgtcacatctggcacctggagaaggagagaagagaaaatgggctcaacaa
gagcctgacacacacagccctcccaagcagcagtgggatggggaacagcaccattaaaggaaaagggacttcagccatagc
cacatcaaaggatgagagcccagcccagagcagcccagcacagaggcagctccatggagcagggctggggatgacaagat
gctgtatctttacaaggataggtacagtgtgggtaagtgtcagagtaatctctcatacatctaggtacagacaggagggcatttaca
aacacggccacgcagagaggacagaaacctgcctcagccccacagcgctgataagccattactcagtaagtgcagaaagtttc
cattttaactcaggcctgttactcagttttccatctccctgtgtcactgatccccaacttggactccagtgaaggctaaccatgatca
gccttctgtgagctgagaaaaggagtgtagtgagcagggagagcactgcaataggagctgatagtgatcacacaggcctgtac

Figure 12b Unit2 Seq Id 188 (con't)

tatgggcagatgggagtttaagagtgaattgcggtccatggcatatgcctgtcagcatagggatgctggaggaattgcaccttgg
catgagcccctctcctcctggtgatgcttgcccacagctctgacgtcctgggaaggctcactgcaccttgttgtcagtgaaactgc
aataagctatcaagatttgatataattctgcccctctgatctacttgtgagaccacacctggagtactgcatccagttctggtaccac
caacacaaaaaggacatggagctgctggagcagggccagaggagggccatgaagatgaacagagggctgaagcacctccc
ctatggggacaggctgagagacatggggcttttgagactggagaagagaaggctccatgggacctttcagtgtccttccaatact
tgaaagggtccttgaggaaagctggggagggacttcctataaggacatatagcaacaggacaaaaggaaagggttttaaactg
gaagaaagtagatttagtctagatagtaacaagaaattcttttacagtaaggatcacgagacactgaaacaggttgcccaaagcag
ctgtggatgcccccctccctggaagtgttccaggccaggctggatggggctttgagcaacctgttctagtgagaggtgaccctgcc
tacagcaggggagttgaacctagatggtcttaaaggtccttccaacccaaatcattctatggcaattctatagagaacacctatgc
tgagagtagctacaagtatggctggttgtgccagatgtgtcatctggatgacccagtctccatccttactctctgcatctacaggag
acagagtcaccatcagttgtcggatgagtcagggcattagcagttatttagcctggtatcagcaaaaaccagggaaagcccctga
gctcctgatctatgctgcatccactttgcaaagtggggtcccatcaaggttcagtggcagtggatctgggacagatttcactctcac
catcagttgcctgcagtctgaagattttgcaacttattactgtcaacagtattatagtttccctccgactttcggccctgggaccaaag
tggatatcgaactcacagtgacatggagcaattaaaaatgatgcataaccttttgcacatctgtaatgctataaggtgagagaaagt
aagcaataatagcagagcagcacaatcctaggctacagcaaatgagaacaagcccagatgcagccacagaaataaagaaaaa
aaaactgcttacctttagaaagcctcatatagacagggatctccagcaagataccacacctccactgccaacccttaaatgagg
gctgggatgggctggatcctggctccaccccttttcaatcactcaggtacattgcacacacctgagctcccctggctggccctgcc
ttcccaccaggtgctcaatcactgctttgggctgtgactcagcatctccactacagcatcacagggagcggttgtcggtctctgct
gttcctatgtgggtgccccgggacacctgaaggcatgagtggcagtgagggctcccagctctatccatggtgaatttgagatcca
ccttggtcccaccgccgaaagtgagagaataactattatactgttggcagtaataagttgcaaaatcatcaggctgcaggctgctg
atggtgagagtgaattctgtcccagatccactgccgctgaaccttgatgggaccccactttccaaactggaggcatcatagatca
ggagcttagggggctttccctggtttctgctgataccaggccaaccagctactaatactctgactggcccggcaagtgatggtgact
ctgtctcctacagatgcagacagggtggaaggagactgagtcatctggatgtcacatttggcacctggagagggagaggagag
aggggagaaaatggatctgagcaattgcctgacacacacagccctccccagactgtgggatgaggccctgtgcccgcagtca
catgtggaatatcaagacacacacatctatgacaatcacaatctgattatcaaccggaccagaagtgacatccagtcacccagtct
ccatccacactgtctgcatctgtaaggagacagcgtcaccatcacttgccgggcgagtcagagcattggtagtaatttagactggt
atcagcagaaaccagggaaggcccctaagggcctgatctatgctgcatccagtttgcaatctggggctccttcgcggttcggtg
gcagtggatctgggacagattttactctcaccatcagaatcctgcagcctaaagatgttgcaacttattactgtcaacagtataaaaa
ttaccctatcaccttcggccaggggacacgactggagattaaacagctgctcctcctgggccccatctgctgagagtgattctca
gagcagccaggcttgaaggtcctgcaggttttgttggaaggggccagggtgactcctctgaggcccccctcctttcctcctccttg
gcggcagcagtacacactttgggtaaccttccgtgtctgctgagatgcagtcagataggagaattctctgatccctcaccacctgc
acacaggggcagtgtccccaggtgtccacatcagacccaggttgcacaggtctcctacagagaatgtctctctggggtctcagc
agagagaggaccagtgtgtgtagaggtccacgctctcctcacggctcagcccagctttgctgctgctgctccacctgtgacagg
ggctgcagggcttgcacagcccagaacctggagaagctgagcagctcctcagtgtggttctggtggacgtcactgaggccag
ggcggcttctgctttctcttatttcctaatggcctttgtaacataaaagagcaataaatagaaaacatagtgagggctatgatttataa
aactggctgtgcttggatcctgccacacactgggagtcctacatggagttttgtgctctggactgtggcctgacccagcctcagct
gacaggctcatccgggaaactaccagcacgtggaggattttctctctctctcttctctctctcactttgtcttcaccaatgctcagtc
tttcaagtaaataaataaataaatatttttaaaaatgggaaatattacatttaataaaataaatgggggcacatgtgcaatcgtgtca
gttttcaatctgatggagtagttcttgattcaatgcaaaatcaagtagaacattctcatccaattgcactaatagcagcttcactgttgg
cacataaaggcacacaaagaatagtagcacaaattcttaggcctgaaataattggaagaagtcgaacagagcccttatgtcata
gatctttcattttagtgggccgggcagatgagaaacaaaccaatgacgttccaactgtgctcccactgtgtccatgtgatgtgcctc
ccatggagcagggccagtgctcaggacaatggggctgtgggtgtgcaggtgcatgtgtgcctccttctgtctccacctagacag
ggcagaggcagaggcagaggagagggaatgtatcgggcaactccacatctgtgtttcctgaaaaataaactcattgtactctcg
gtgatggtcgggtagacaaactgtcctgacaaaagattttaagatttctcatgtccctgtagcataaagtcagtcagcacacaggtc

Figure 12b Unit2 Seq Id 188 (con't)

agagggaataatcagtgcccagacactggagataaaaaaaatggagcccagttttagtgcgcattagcagggaatgtgatcaga
agtggagcagtgggcttcaatccagtgtctgatgtaggctgctggctttgcaagtggcaacttaatccatgtaccatgatgccagt
ctaccctcctctctagattttcttagagataaagtgaaggtttcaggagagaggagagaaggaagttattttcttgatgtcttcagac
ctatggtgaggccttgaactttcacttttctttcctcctgcatccttgactcagaactctggctgcaggtgggagagcacacatgtgt
gatctctcatctaagcacctgtgttatccttctgagtcctggtctctggcagccgcttgttctgaggatgtttattctgagtcagtacag
aggtaagtgtgggtagaagtctcgtctctcagagacaatctccctggtgcagcggtctccatgaggggacaagatgagggatca
aaggacaaacaggtgaaagacatggacctcagctttaaggtgtaactaagtattccctagaaaagcatttctactaaagaattcca
ccataagcatgaacaaattacaccttcttgtcctccagttcaattatagggttggcaaatgtccctcagggaatttgggaggtgatgt
ctcctggtggaagcatgcgcactgcaggtaaacttgtgcagccctggtctgagctggggcagctggagacacagcccctggac
tgagttctgaactgccctgggcccttcagctgggcacagccctgccccgccctgctcatttgcatgtccccagagcaccgccc
acctctctgggcatttaggagcaggctgctcccgccccatgcaggaggcagtgccaggcaggacccagcatggacatgaggg
tccccgctcagctcctggggctcctgctactctggctccgaggtactcgttgcgcccggtcggggactgtgggcacggggctct
gtcccattgctgcgcgggcagggctgtgcgtgcggggccgtcactgattgccgttttctcccctctctcctctccctctccaggtg
ccagatgtgacatccagatgacccagtctccatcctccctgtctgcatctgtaggagacagagtcaccatcacttgccgggcaag
tcagagcattagcagctatttaaattggtatcagcagaaaccagggaaagcccctaagctcctgatctatgctgcatccagtttgca
aagtggggtcccatcaaggttcagtggcagtggatctgggacagatttcactctcaccatcagcagtctgcaacctgaagattttg
caacttactactgtcaacagagttacagtaccccctctcactttcggcggagggaccaaggtggagattaaaggtaagtggccgttt
cactgattcctcaccgtttctgcctgattggtttgttttttccacttttcgctgtttgtgtgtctttgttggctggaggtcagggttctaac
gaatttctttccaagatgaggcacagaggagggaaaactgtctgagatttccaagtcaaaataacttccccgggggagagggcttg
ccgccttgtcagggagggttttgtggagggagaaggtaaagggagccaccgtgaagttcctattccgaagttcctattctctaga
aagtataggaacttcccctttctgtccaactgtgaggtcttggtccctggatcacctgggcaagtttgtgatgtttcagttaaatgag
ccattcctggcgaccccaaaagtaaatagaagaaaataatcaaaagcggagaagacagaaatttgggggtttgggagaatagg
agagaaacagcagaagtttctctacagttgccgtgtggtgggactggccgcaaagggaggttttgtgaggggtgggatgacag
agtgacttacttttggctcagggaggcgcgcc

Figure 13a Unit 1 6607bp Seq ID 189 ggcgcgccataacttcgtatagcatacattatacgaacggtaaggggagtgcggctccaccaggggcgcgcaagacacact
gagtccagattctggtcctgctcaggcacagagggagatgaagccctggtttcctgtcagggatttgggtttcctctcctacagtttt
gagggaagacttctacttcaggattctgtcccttacactgacgccactgacgtagagaagctttatgtgacaggaagaagtcttaa
atggacacattcaggtttgtgaacgatgacagtggtcaccagggtcagagatgtgagacaatcaggggacctcgtgagtgttgtc
cagtctgactcaggacagcgttccaggacactgccgactataagacaattttagttttccttcaaacccagacagacccgagcca
gagtcttgatttgctacctcagttttataagtcgtcccatcctcctgtcagagcagcctgtgtgctgcactgaaccaaccgtcttatttt
aactgtgggtgttctgcattcactttctacagactttatacccaatctccatttcccttttaatcctgaaacagtctgtggtccctgtgtgc
acttccagctgatctggttctgctccagtgtcgtgggaaccctgcacctgctgtggttcagggagagcagaaagtgggacaca
gagcggctgtgcactctggggctggagtccacatcacggggagctgtgtctgtggctccagcatgatgcccagtgtcctgagg
ctgaatcacagctgcaggaagagccagtcccagagaccatgtgtccagagtccctgctcttcactccatgtctatgctgactggg
gtcatcaatccatttgtgttctttcatcagtattagagagggagacacccaggctgcatatcacattgctggatggagcccatttgca
cgctttcccatacttgtactgacagtgcaccctggaagacagtacatgatggatctgtatgaggccccatcaccaaggtgggaac
actgatgcagtttcatgctcctgggttccagctgacaagcttgagtccactgcctttatttatcatctccataaaacatggccaacac
aacaccagtattcaaagatcaatcgtcatgattggccatcgttgctatttcatattcctaaatgtttgataaataatattgagtatagctc
tatgaggtacaatgatatgtgtggacaaaatgaatgcatattgagtggaattatgaagtcaggcttgatgacacattcataccacaa
cacatgttttggtggagttcacctgtctcctgctcttaagagatttccactcacaatattctcttaacctctgtcaccatgctgtgcagt
agatccctcagtgtgtggagcctgtgggactaaaactctgaccttgctccagcgtctcctctgttcctccctcgctcagactttggtc
ttcaccattgtacttcctgcctctgtgccttcagccttttatcccatgtaggtagcatcacatattatgtgtcttcctggcctggatgctta
gcagagtgtacttttactgacatattatcttaggcacattattctccgggatcatccaagttgtccaaaatcacagaatttcttactctgt
actgcttttaaacttccttttaaaatgtaactttgtccatttctttcattttccattcttgcttccatgagatgtcactggatcatatgtgtgaa
ctcttttgaatggcggtgctttaaatgaacaaggaactgcagaggtgtttgccacagtgactgcagatcccgtggacacctccctg
ggatttcatattcattgtaccatgcaatggtgcttgaagatcatgtaataattctgtttctagttttgatgcttttccataatggttttacta
attaacctgacacagacttgtaccagggttatcatctctctctacctccataaaacatgtcagctctggtatgtctgataatagtcattc
taacaggagggatgggatgtctcattgtgcttctaacatggacatacatgatggtcctagatttgtagcattttatatgtttgtctttata
tcttcttttgaaatttatagatgtaacataaattttaaaatttatcattttattggccagcgcatggctcactaggctaatcctccacctgc
ggtgactgcaacccagtttctagtctcggtcgggcgccggattctgtccggttgcccctcttctaggccagctctctactgtggcc
cgggagtgcagtggaggatggcccaagagcttgtgccctgcaccccatgggagaccaggagaagcacctgactcctggcttc
ggatcagcgtggtgcaccggttacagcggccattggagggtgaaccaacggtaaaggaagacatttctctctgtctctctctctgt
cactgtccactctgcttgtcaaaaaagtgtaccattttatttaaaaatttgtctttatatatttgtccaaaaccacagagagactgagact
gacagtgatcttctaattcctggtcacttctcagatggctaccaaagattcagctgggtcaggcgacagccaggtgcttggaattct
gtccagggctcccacgtgggactacttggaacttcacctatggcctcccagaggggcttaggaaggaatatgagactggaacc
aaactaggacacagcactcagcatcctcatacaggagcaggaatccatcaggctcactccagtgctgctcctgtcaccacccttat
catcactgcatttaaggaattgatttcttcccttgggattcagttgtttgagatcttcaacattaggaaataggctttcaatcatatgtata
attaatcttcaatttatttttaagtatctatttttatttagagacagtgttatagcaagagatgaagagaccaacagatggagagagaag
cttctgtccagtggttcacttcgtgaatggctgcaaaggctatgatggctgagcctaaagccaggagcctggaacttcctccagttt
cccacagggctggaaggggacaaacactttggtcatggtcgacagtgatcaccattgcaatgcctacatctgtgagttcaattgtg
gactgcatatacaaataatgtcacatactatgtgtccacatctacctggatcatttcttttagtatgtatgctccaggctgacccatgttt
cctactgacagaacgacctccttcttaatactgaataatattccatgtccaaatgtgaaagaatccattcactgttctgtgaacacttg
cttaattgtagactgaactattatgaacacagctgcattacctgaacccaggactgcgggtgaattgtgacacagtgacttctaccc
agtgcttgagctgaactcagagtcatgattacagaacagggaagagggggaacacagggcagctgataacaggacgcaaag
caccactcacaggaaggaataattctgcctacaccacagtgggctgactcagttcaccacaaaccccatgacaggttccacaaata
actagaactgaggtctccaggcctcccaacagagtgatggaaaggaggtggaaatgtgcatgacactgagttcatctgtgccca
tttctaccatgcacattccaatagcacacaaaccccactaccatgtacagtgttctgtgttcaggaacagttttaaactaaagcaatg

Figure 13a Unit 1 6607bp Seq ID 189 (con't)

gatgaataaatgaacaacacatagttaaccttaaaaaatcaacttgcagtccttcatctatttaaaagtgggcagcaggcattagga
caaaattggctaagtccccactagggtcacccgtgttcccatcagagaactgactgagcccagcctcacggcttcccacactttc
cctcataatgcatcatgggaaactgtagatgacactacaggcaaaggagcccctaccaccgacgttggaattacagacacagttt
cttgcttcagggttcagaaagactaactcctaggggtcataggcatttgggatgtctagggctctcaacccaaaggcagaaatctc
ccattgtcaccttttctgtccatctctacatttctgtaactctcaccccttctatctctatctctgtcccaatgtctttcatatagatgataag
gaactaatgggatttaaataaatgaggaacatgatattgctaacactggatattaagggtgcacacatattaaaatgaaacaaggta
tctgccttcaacttttaaaataattataacataaaaattcatatgatctgaatcatatcacagccatcaccgtacacccccaggtcac
cacatctgccctgggcgctgtcctgtctgaggcgtctgacccatgcctgctatataggggcagctcatgcaaatgggcctccc
tgtgcccatgaaaaccagcccagccctcaccctgcagctctggcacaggagctccagccccaggactcccaggtgtccactca
gtgatcgcactcaacacagacgctcaccatggagactgggctgcgctggcttctcctggtcgctgtgctcaaaggtaatgatgg
ggaacgcgggacactgagtctgggagaggatgtgagtgagagacacagagagtgtgagtgacagtgtcctgaccatgtcgtct
gtgtttgcaggtgtccagtgtgaggtgcagctgttggagtctggggggaggcttggtacagcctggggggtccctgagactctcct
gtgcagcctctggattcacctttagcagctatgccatgagctgggtccgccaggctccaggaaggggctggagtgggtctcag
ctattagtggtagtggtggtagcacatactacgcagactccgtgaagggccggttcaccatctccagagacaattccaagaacac
gctgtatctgcaaatgaacagcctgagagccgaggacacggccgtatattactgtgcgaaagacacagtgaggggccctcagg
ctgagcccagacacaaacctccctgcagggtcgcgcggctctaccaggggggcgctcaagacgcactgagtgcagattctggt
cctgcacaggcgcagaagatgaagccctggtctcctgtgagggaattggggtttcctctcctgtagcagttttgagggaagaatt
ctacttttttgattctgtccttcccaacttcactgacggagagaaagtttgatgtaaaaggaagaagtcctaattgaacaatttggttcat
ggacagcgactgtgctcaccagggtcagagatgtgggaatattgaggactctattgagtctcttccaacctgactcaggacagca
ccctcagggcactgaaagctttggacagtttcagttttccctgtataaccagggacagctgagacagggtcgttgatctgttaaac
agcaactattccactcatccctctcctgccacaaccagcaagtgtgcactaaaccaacctttgactctacatgtgggtgatccacac
tcactttctgcagactttaaccccgacctgcatttccctttaatcctggaacagtctgtggtccttgtgtgaacgtcacagcactcagga
atgtactgcagctcagctgtgtctcaggctgagcttctgcaggcacctgggaagcctacagggacttcctcatcctctaggtcctg
ggaccctcctggggggctccctgcctgaactcaggagggaaatgccctggacatcagcagtcaaggtcatcactgaatggaaa
gtgttgggtgtgcacttccagctgatctggttctgtcaagtgtcgtggcacctcctgcacctgctgtggttcagggagagcagaaa
gtgggacacagagtggctgtgcactctggggctggagtccacatcacggggagctgtgtctgtggctccagcatgatgcccag
tgtcctgaggctgaatcacagctgcaggaagagccagtcccagagaccatgtgtccagagtccctgctcttcactccatgtctat
gctgactggggtcatggatccattcggagtctttcatcagttttagagagggagatagatacacaggctgcatatcagagttctgg
acagagcacatttacactatttctatacttgtaagtgaaaatgcaccctaaagacagcagatgatggaccagttatgaagccccat
gaacaaggtgcaaacgctattgcagttccatgctcccgggttccagctgccaagcctcaaattaactggcatttatttatcatctaca
taaaacactgagaaacacaacaccagtattgagcgaactgaatctgtagttggccatttttgtcattttattttcataaatgtttgataaa
taataattgaacatagacatgagataaatgatatgtgttcaaaaatgactgtatcaaattgatggaattatgaagtcattcttattgaca
tgctcatcacaaaatccacatgttcccatggtcgaatgtcagtggtctcctgttttggaattcaatagacccaatattcatacgcgt

Figure 13b Unit 2 15699bp Seq ID 190 ggcgcgccgcaacccagtttctagtctcggtcgggcgccggattctgtcccggttgcccctcttctaggccagctctctactgtgg
cccggggagtgcagtggaggatggcccaagagcttgtgccctgcaccccatgggagaccaggagaagcacctgactcctggct
tcggatcagcgtggtgcaccggttacagcggccattggagggtgaaccaacggtaaaggaagacatttctctctgtctctctctct
gtcactgtccactctgcttgtcaaaaaagtgtaccattttatttaaaaatttgtctttatatatttgtccaaaaccacagagagactgaga
ctgacagtgatcttctaattcctggtcacttctcagatggctaccaaagattcagctgggtcaggcgacagccaggtgcttggaatt
ctgtccagggctcccacgtgggactacttggaacttcacctatggcctcccagaggggcttaggaaggaatatgagactggaac
caaactaggacacagcactcagcatcctcatacaggagcaggaatccatcaggctcactccagtgctgctcctgtcaccaccta
tcatcactgcatttaaggaattgatttcttcccttgggattcagttgtttgagatcttcaacattaggaaataggctttcaatcatatgtat
aattaatcttcaatttattttaagtatctatttattttagagacagtgttatagcaagagatgaagagaccaacagatggagagagaa
gcttctgtccagtggttcacttcgtgaatggctgcaaaggctatgatggctgagcctaaagccaggagcctggaacttcctccagt
ttcccacagggctggaaggggacaaacactttggtcatggtcgacagtgatcaccattgcaatgcctacatctgtgagttcaattg
tggactgcatatacaaataatgtcacatactatgtgtccacatctacctggatcatttcttttagtatgtatgctccaggctgacccatg
tttcctactgacagaacgacctccttcttaatactgaataatattccatgtccaaatgtgaaagaatccattcactgttctgtgaacact
tgcttaattgtagactgaactattatgaacacagctgcattacctgaacccaggactgcgggtgaattgtgacacagtgacttctac
ccagtgcttgagctgaactcagagtcatgattacagaacagggaagaggggggaacacagggcagctgataacaggacgcaa
agcaccactcacaggaaggaataattctgcctacaccacagtgggctgactcagttcaccacaacccatgacaggttccacaaa
taactagaactgaggtctccaggcctcccaacagagtgatggaaaggaggtggaaatgtgcatgacactgagttcatctgtgcc
catttctaccatgcacattccaatagcacacaaacccactaccatgtacagtgttctgtgttcaggaacagttttaaactaaagcaa
tggatgaataaatgaacaacacatagttaaccttaaaaaatcaacttgcagtccttcatctatttaaaagtgggcagcaggcattag
gacaaaattggctaagtccccactagggtcacccgtgttcccatcagagaactgactgagcccagcctcacggcttcccacactt
ttccctcataatgcatcatgggaaactgtagatgacactacaggcaaaggagcccctaccaccgacgttggaattacagacaca
gtttcttgcttcagggttcagaaagactaactcctaggggtcataggcatttgggatgtctagggctctcaacccaaaggcagaaa
tctcccattgtcacctttctgtccatctctacatttctgtaactctcacccccttctatctctatctctgtcccaatgtctttcatatagatgat
aaggaactaatgggatttaaataaatgaggaacatgatattgctaacactggatattaagggtgcacacatattaaaatgaaacaa
ggtatctgccttcaacttttttaaaataattataacataaaaattcatatgatctgaatcatatcacagccatcaccgtacacccccaggt
caccacatctgccctgggcgctgtcctgtctgaggcgtctgacccccatgcctgctatataggggcagctcatgcaaatggggcct
ccctgtgcccatgaaaaccagcccagccctcaccctgcagctctggcacaggagctccagccccaggactcccaggtgtcca
ctcagtgatcgcactcaacacagacgctcaccatggagactgggctgcgctggcttctcctggtcgctgtgctcaaaggtaatga
tggggaacgcgggacactgagtctgggagaggatgtgagtgagagacacagagagtgtgagtgacagtgtcctgaccatgtc
gtctgtgtttgcaggtgtccagtgtgaggtgcagctggtggagtctgggggagccttggtaaagcctgggggtcccttagactc
tcctgtgcagcctctggattcactttcagtaacgcctggatgagctgggtccgccaggctccagggaaggggctggagtgggtt
ggccgtattaaaagcaaaactgatggtgggacaacagactacgctgcacccgtgaaaggcagattcaccatctcaagagatgat
tcaaaaaacacgctgtatctgcaaatgaacagcctgaaaaccgaggacacagccgtgtattactgtaccacagacacagtgagg
ggccctcaggctgagcccagacacaaacctccctgcaggggcgcgcggctccaccaggggggcgcacaaaacgcactgagc
ccagattctggtcctgcacaggcgcagagtgagaccaagccctggtttcctgtcagggatttaggggtttcctctcctgtaacagttt
tgagggaagaattctacttttttgattctgtccctcccaacttcaatgacggattgaaagtttgatgtaaaaggaagaagtcctaaatg
aacaatttggatcatggacagcgactgtgctcaccaggatcagagatgtgggaatattgaggacactattgagtctcttccaacct
gactcaggacagcaccctcagggcactgaaagctttggacagtttcagttttccctgtataaccagggacagctgagacaggt
cgttgatctgttaacagcaactattccactcatccctctcctgccacaaccagcaagtgtgcactgaaccaacctttgactttatatgt
gggtgatccacactcactttctgcagactttaacccgacctgcatttcccttttaatcctggaacagtctgtggtccctgtgtgaacgt
cacagcactcaggaatgtactgcagctcagctgtgtctcaggctgggcttctgcaggcacctgggaagcctacagggacttcct
catcctctaggtcctgggaccctcctgtgggctccctgcctgaactcaggagggaaatgcactggacatcagcagtcaaggtca
tcactgaatggaaagtgttgggtgtgcacttccggctgatctggttctgctccagtgtcatgggaccccctgcacctgctgtggttc
tgggagagcagaaagtgggacacacagaggctgtgcactctggggctggagtccacatcacagggagctgtgtctgtgactc

Figure 13b Unit 2 15699bp Seq ID 190 (con't)

cagcatgatgcccagtgtcctgaggctgaatcacagctgcaggaagagccagtcccagagaccatgtatccagagtccctgct
cttctctccatgtctatgctgactggcgtcatcaatgtatttcagtctttcatcagttttagagagggagacacccaggctgcatatca
gagtcctggacagagcccatttacacaataccacacttgtactgacaatgcaccctggaagacagtagatgatggatctgttatga
ggccccatcaccaaggtgggaacactgatgcagttccatgctccagggttccagctgccaagccttgagtgcactgccttcattt
atcatttctataaatctccatatatacttccttttaaatataactctgtccatttgtcccattatccattccttcttcaatgctaatttcactgg
attatgtgtgtgaactcttgagaatgacgctgctttaattgaacaggggactgcagagatgtttgtcacagtgactgcacatcccgt
ggtctcctccctggatttcatattccttctacccaggcatggtgttggaggatcctgtgataattctatttctcagcttctgatgttttcca
tgaaagctttcctaatttacctgactccagcctttaccaggttatcatctctctcttcctgcacaacatgtgtcagctctggtatgtctgg
tgatactcagtctaagaaagggatggggtatctcattgtttctccaacatgtacgtgcatgatgatcccagatttaaagcattttatac
atttgcctttatatattttattttaaaaattacagatacactttcacctcttttaaaacttgtatttgtgtatttgtccaaaaggaaaaagaga
cagagactgacagacagtgatctactgaatcctggtaacttcccagatgcccataaaagctgagttgggtcagatcatacaggtg
catagaactcagtccaggtctcacacatgggataaactcagacttctcatactgcctcccagagtgcacattggcaggaatctgaa
attgggatctaaactgggacataaacctgagcatcctgatgcaggaggcaggaatcccacgtgatacccctcaatgctgctcctat
cacccaccttgtcagtcactgcatttaaaccattgattgcttccctgtgattcagttgcttgagttcattcaacatttggatctaggctc
ctaatcatatgtacaattatctttcatttattttgaatatctatgtatttgatttgaaaggcagtattatagcaagagaggaagagaccaa
cagagggagagagaagcttccatccactggtttccttcctgaatggctgcaaaggctgggcaagggcaagactgtagccagga
gcctggaacttcctccagtttcccacagagctcgaaggggacacacacttgagtcatcgttgacagagttctctggtccatgagc
agggagctggatttgaagtgcagcaagcaagatctgaacccatgctgctgagtgaagctgcatagggatggcagcttaacctgt
ggggccacaatgttggggagtaggccatgagggttgctgcctgcattgaagggaatacgacccttagaaagacccttcaggcc
ggcgccgcggctcgccagactaatcctctaactgcagtgccggcactccgggttctagtccaagttatggcgccggattctgtcc
tagttgctcctcttccagtccagctctctgctgtgacctgggagtgcagtggaggatggcccaagtgcttgggccctgcaccctca
tgggagaccaggaagaagcacctggctcccggcttcgaataggcacagcgcgctggtggaggcggacatttgggtgataaac
caacggaaggaagacctttctctctgtctttctctctctctcatctctgcctgtcaaaaaaaaaaaagaaagaaagaaaagaaaa
gaaagtaagacccttcagtaacttaattttaaatttgagttataacacatgaatcagagaggagaatgagagaaagagagatgttc
cgacactgtgctttcccaaatgttgctgtggccaggtctgcttcccagcttagcccggtctcaggaaaacaatcaggtgcatccac
aagcgtgacagggcccaaaattcctcccataaacttctgggtcctggggctgcaggagcaggaaactggtactgggagccaga
gccacacatgggaccctggcactctcttggggggatgtgctcatcttaaacagtgcaaatttcaatttattatttcctttatttccatgaa
atttgatgcactcagatgcacctacgtgaaacctggtcctctgtgcatctctctgttaaaaatggaatccagcaaaagtgctccttgtt
ctgctgctggcagggagttctgcagacctcaccaggaagccccagtgagtgctaagggtggactggggcagagctgagtcct
gtggtgaggggcatggatcaaggtgctggggactcctcttaccacactggagtggggacacatccacactgtactgatgatttct
cctgtaacgttgaaatggaccaagacctaagggaacccatgaatacacattgtaggtccattcacataaaaggaccaagagagg
gttcagtgtgcaatgagagcatacaatttatcactcatcccacatatgataatgtcagactgccccgggacactctcatcagtctg
gacactatcatactaaggagtctgacgccagggctgctatataggggcagcacatgcaaataggggctccctctgcccatgaaaa
ccagcccagccctcactctgcagctctggcacaggagctccagccccaggactcccaggtgtccactcagtgatcgcactcaa
cacagacgctcaccatggagactgggctgcgctggcttctcctggtcgctgtgctcaaaggaaatgaagggccagtgcccgag
ctcactaggctaatcctccgcctttcggcgccagcacacaggttctagtcccggttggggcgctggattctgtcccggttgccc
ctcttccaggccagctctctactgtggccagggagtgaagtggaggatggcccaagtacttgggccctgcaccccatgggaga
ccaggataagtacctggctcctgccatcggatcatcgcggtgagccggcctcagtgagctgacacggtgaccattggagggtg
aagcaacggcaaaggaagacctttctctctgtctctctctctcactgtccactctgcctgtcatataaaaaggtaatgatggagaa
tgcagggcactgagtttgggagaggatgtgagagagagtgtgagtgacagtttcgtgatcatgtcgtctgtgtttgcaggtgtcca
gtgtgaggtgcagctggtggagtctgggggaggcttggtccagcctggggggtccctgagactctcctgtgcagcctctggatt
caccttagtagctattggatgagctgggtccgccaggctccagggaaggggctggagtgggtggccaacataaagcaagatg
gaagtgagaaatactatgtggactctgtgaagggccgattcaccatctccagagacaacgccaagaactcactgtatctgcaaat
gaacagcctgagagccgaggacacggctgtgtattactgtgcgagagacacagtgaggggccctcaggctgagcccagaca

Figure 13b Unit 2 15699bp Seq ID 190 (con't)

caaacctccctgcaggggcgcgcggctccaccaggggggcgcacaaaacgcactgagcccagattctggtcctgcacaggcg
cagagtgagaccaagccctggtttcctgtcagggatttagggtttcctctcctgtaacagttttgagggaagaattctacttttgatt
ctgtccctcccaacttcaatgacggattgaaagtttgatgtaaaaggaagaagtcctaaatgaacaatttggatcatggacagcga
ctgtgctcaccaggatcagagatgtgggaatattgaggacactattgagtctcttccaacctgactcaggacagcaccctcaggg
cactgaaagctttggacagtttcagttttccctgtataaccagggacagctgagacagggtcgttgatctgttaacagcaactattc
cactcatccctctcctgccacaaccagcaagtgtgcactgaaccaaccttttgactttacatgtgggtgatccacactcactttctgca
gactttaacccgacctgcatttcccttaatcctgaaacagtctgtggtccctgtgtgaatgtcacagcactcaggactgtacttgca
gctcagctgtgtctcaggctgagcttctgcaggcacctgggaagcctacagggacttcctcatcctctaggtcctgggaccctcct
gggggctccctgcatgaactcaggagggaaatgcgatggacatcagcggtcaaggtcatcactgaatggaaagtgttgggtgt
gcacttccagctgatctggttctgtcaagtgtcgtgggaacccctgcacctgctgtggttcagggagagcagaaagtgggacac
acagaggctgtgcactctggggctggagtccacatcacggggagctgtgtctgtggctccagcatgatgcccagtgtcctgagg
ctgaatcacagctgcaggaagagagagtcccagagaccatgtgtccagagtccctgctcttcactccatgtttgtgctgactggg
gtcatcaatttatttggagtctttcattaatattacaggctgcatatcagagtcctggacggagcccatttacacattcaccacacttgt
actgacaatgcaccctggaagacagtagatgatggatctgttatgaggccccatcaccaaggttggaacactgatgaagttccat
gctcctgggtttcagctgccaagccttgagtacaatggcctttatttaccatctccataaaacattggcaagcacaccagtattttcc
gtttttgccgtttcattttttataaatgttttataaataataattggatatagacatatgaggtgcaaggatatgtgttcaaaattgaatgtag
caaattgatggaattatgaagtcattcttattgacatgctcatcacaaaatccacatgttcccatggtagattgtcagttgtcttctgtttt
ggaattctgtagacacaatatttgcttaactgctgtcaccatgctgtacagtagatccctcaacatgtggatcctgtgggactgaaac
tctgaccttgctccaatgtctcctctgttccatgcccttttcttccattattgattccttcttccatgaaaatttcactggattatatgtgtga
acactcgtgaacgacgctgctttaattgcacatggaactgcagttgtagtttctatagagactgtgaatcccatgcacatctccctgg
gatttcacattcctgctacccaaaatgctgtttgaagatcctgtgataactgtatgtctcagttttttgatgactttccataatggatttact
aatttacctgactccagccttgtacaaccagagtggtcatctctcttccttcacaagaattgtcagctctggcttgtctggtaatactca
ttctaacatgaaggatggacatctcattgtgcttctaaaatgtgcatacatgatgatctcagatttatggcattttacatgtttgcttttat
atcatttcttaaattttatagatgtaatctacagttaaaaattcatagattttattttaaaatttgtctttatgtatttatctaaaaccacaaag
agactgagactgacagtgagattctatctcctggtcactaccaagagggctacaaatgcttcagttagatcaggtgacagccagg
ggcttggaattctgtcaggtctccacatgggagtacttggaacttcacctatggccacgagaaccaaactaggacacagcactaa
agaacctgattcggggccggcgccgcggctcactaggctaatcctccgcctttcggcaccggcacaccgggttctagtcccg
gtcggggcgccgtattctgtcccggttgcccctcttccaggccagctctctgctgtggccagggagtgcagtggaggatggccc
aggtgcttgggccctgcaccccatgggagaccaggagaagcacctggctcctgccatcggatcagcgcggtgcgccagccg
cagtgcgacggccgcggcggccattggagggtgaaccaacggcaaaaggaagacctttgtctctgtctctctctcactgtcc
actctgcctgtcaaaaaaaaaaaaaaaaaagaacctgacacaggaggcagcaatcccacatgctaactccagtgctgctcctgt
caccaccttatcagtcactgcatttaaacaattgatttcttcccttgggattcacttctctgtgtttattcaacatttgcatataggctccta
atgatatggataattaatctttcatttattttaatatctatttattttgittgaaaggcattgttatagcaagagatgtcgtctgtgtttgcag
gtgcagctggtggagtctggggaggcttggtcaagcctggagggtccctgagactctcctgtgcagcctctggattcaccttca
gtgactactacatgagctggatccgccaggctccagggaaggggctggagtgggtttcatacattagtagtagtggtagtaccat
atactacgcagactctgtgaaggggccgattcaccatctccagggacaacgccaagaactcactgtatctgcaaatgaacagcct
gagagccgaggacacggccgtgtattactgtgcgagagacacagtgaggggccctcaggctgagcccagacacaaacctcc
ctgcaggggcgcacaagacacactgagtgcagattctggtcatgcataagtgcagaaggagcccaagccctggtttcctgtc
agggaactggggtttcctctcctgcaacagttttgagggaagaattcttctttgatgattctgaccctgtactgactctctgatgtgac
aggagaagtcctacatgaacgaatttaggttcagtggtctccagtatcagagatgtgggacaatctggggacttagtgagtgttgt
ccagcctgagtcaggacagagttcataggacactgccgactttagggcaatttttactttcccttttcaatccagcaatagctgagcc
agggtttgagtttaaaaatctgctatttaagtatctctctcctttcaaaacgagcgactgtgctgaactgaaccaaccgtcttattttaa
actgtgagtgttctgcatcatttctaacagactttataccccgatctccatttttcctttaatcctgaaacagtctgtggtccctgtgaac
gtcacagcactcaggaatatacttgcagctcagttgtgtctcaggctgagcttctgcaggcacctgggaagcctacagggacttc

Figure 13b Unit 2 15699bp Seq ID 190 (con't)

ctcattctctaggtcctgggaccctcctgtgggctccctgcctggactcaggagggaaaaacactggacatcagcagtcaaggt
catcactgaatggaaagtgttgggcgtgcacttccatctggtctagttccgctccagtgtcgtgagaccacctgcacatgtgtggtt
cagggagaggagaaagtgggacacacagtggctgtgcactctggggctggagtccacatcacggggagctgtgtctgtggct
ccagcatgatgcccagtgtcctgaggctgaatcacagctgcaggaagagccagtcccagagatcatgtgtccagagtccctgct
cttcaattcatgtctatgctccaaatgtcaatccatttggagtctttcattaacattacagtgggagtcactcaggctgcatatcacatt
gctggatggagcccatttttcacgctttcccatacttgtactgacaatgcaccctggaagacagtagatgatggatctgttatgaggc
cccatcaccaaggagggaacactgatgcagttccaagctcctgggttccagctgccaagcctgagtgcactgcctttttaatcat
ctccataaaacattggcaaacacaataccagtatgcagagatctgaatcttcatgactggccattgttcatccttttatcccatgtagc
tacctacatcacatattatgtgtcttcctggcctggatggttagcagagtgtactttagtgacatattatcctaggcacattattctcca
gggtcatccaagttgtccaaaattacagaatttcttactctgtactgcttttaaactccttttaaaatgtaactttgtccatttcttcatttc
cattctttcttccatgagatgtcactggatcatatgtgtgaactcttttgaatgaactcttttaaatgaacaaggaactgcagaggtgttt
ggcacagtgactgcagatcccgtggacacctccctgggatttcatattcattgtaccatgcaatggtgcttgaagatcatgtaataa
ttctgtttctagttttttgatgctttttccatacggttttactaattaacctgacaagacttctaccagggttatcatctctctctacctccataa
aacatgtcagctctggtatgtctgataatagccattctaactggagcgatgcgatgtctcattgtgcttccaacatggacatacatgtt
ggtcccagatttatagcattttacatgtttgcctatatatcttcttttaataatttatagatattatataaatttttaaaatttatcattttatttga
gaacttgtctttatgtatttgtacaaaaccacagagagactgagactgtcagtgatcttctaattcctgcgtcacttccccactggcta
caaaagattttgctgggtcaggtgacagccaggtgcttggaattctgtccagggctcccacgtgggagtacttggaactacacct
acgcctcccagagtgtgctcaggcaggaatatgacactggaaccaaacaaggacacagcactaagcatcctgatacgggagg
caggaatccctcaggctcactccagtgctgctcctgtctccaccttatcatcactgcatgtacacaattgatttcttcccttgggattc
agttgcttgagatcattcaacattaggaaacaggctcctaatcatatgtacaattaatcttcaatgtatttaagtatctatttatttatttt
acaaacagtgttatagcaagagaggaagagatcaacaaatggagagagaattccatccactggttaacttcctgaatggctgca
aaggctgggatggctcagcctaaattcaggagcctgacttggatcatggtagacagttttcaccattgcactgcctacctctgtg
agttcaagcttgtgcactgcatgtataactaatgtcacatactgtgtgtccacatctacctggatcatttcttttagtatgaatgctccag
gctgacccacatttcctaatgacagaacaacctccttcttaatactgaataatattcttagtctaaatgtgaaagaatccattcactgttt
tatgcacacttgttctttgtagactgaactattgtgaacaaagctgcattacccaaacgcaggactgcgggtgaattgtgacacagt
gacttctacccagtgcttgagctaaactcaaagtcatggttacagaacagggaagcgtggccggcgctgtggctcactaggcta
atcctccgccttgcggcgccggcacactgggttctagtcacggttggggcaacggattctgtcctggttgcccatcttccaagcc
agctcactgctgtggccagggagtgcagtggaggatggcccaagtgcttgggccctgcaccccatgggagaccaggagaagt
acctggctcctgccatcggatcagcgtcgtgcgccggccacagcacgccaaatgcaacggccattggagggtgaaacaacgg
caaaggaagacctttctctctgtctctctctctcttactgttcactctgcctgtcaaaaaataaaaaaaagaacagggaagagggaa
cacagggcagctgataccagggcagaaagcaccaccaaaggcaggaataattctgcccacaccactttgggctgactcagttc
accacaacacacaacaggttccaagaatgactagaactgaggtctccaggcctcccaacagagtgatggaaaggaggtggaa
atgtgaatgacagtgagttcatctgtgcccatttctaccatgcacattccagtagcacacaaaccccactaccatgtacagtgttctg
tgttcaggaacagttttaaacagtttaaacagttttaaactttaaggcaatggatgaataaggaaaaaaacatagttaaccttaaaaa
attcacttgagtatttcatctatttaaaagtggggtgacaggcattaggacaaaattggctaagtccccactagggtcacctgtgttcc
catcagagaactgactgagcccagcctcacggcttcccacacttttccctcataatgcatcatgggaaactgtagatgatgctaca
agcaaatgaaccccctaccaccgacgttggaattacagacacagtttattgctccagggttcagaaagactaactcctagatgtcat
aggcatttgggggtgtctggggctgtcaacccaaaggcataaatttccccttgtcacttttctgtccatctctacatttctgtctctctca
cccccttctctctctatcactgtaccaatgtctttcatatagatgataaagaactaatggttatttaaataaatgagggacatgatattgct
aacactcgatatgaagggtacacacatattaaaatgaaacaaggtcattgccttcaagttttaaaattatgataacataaaaattcac
atgatcttaattctatcataaccatcacccaacacaccaagaacacagacaacttcccagggccctgtcctgttgaggcatctgac
cccatgcctgctatctaggggcagcacatgcaaataggggctccctctgcccatgaaaacctgcccagccctcaccctgcagctc
tggcacaggagctccagcctcaggactcccaggtgtccactcagtgaacgcactcaacacagacgctcaccatggagactgg
gctgcgctggcttctcctggtcgctgtgctcaaaggtaatgatggagaacgcgggacactgagtctgggagaggacatgagtg

Figure 13b Unit 2 15699bp Seq ID 190 (con't)

agagacacagagagtgtgcgtgacagtgtcctgatcatgtcgtctgtgtttgcaggtgtccaatgtgaggtgcagctggtggagt
ctgggggaggcttggtacagccagggcggtccctgagactctcctgtacagcttctggattcacctttggtgattatgctatgagct
ggttccgccaggctccagggaaggggctggagtgggtaggtttcattagaagcaaagcttatggtgggacaacagaatacacc
gcgtctgtgaaaggcagattcaccatctcaagagatggttccaaaagcatcgcctatctgcaaatgaacagcctgaaaaccgag
gacacagccgtgtattactgtactagagacacagtgaggggccctcaggctgagcccagacacaaacctccctgctaccgttcg
tatagcatacattatacgaagttatggccggccacgcgt

Figure 13c Unit 3 13971bp Seq ID 191 ggcgcgccggaagcctacagggacttcctcatcctctaggtcctgtttctctcctgtggggctccctgcctgaactcaggaggga
aatgcaccggacatcagcggtcaaggtcatcactgaatggaaagtgttgggtgtgcacttccagctgatctggttctgctccagtg
tcgtgggaaccccctgcacctgctgtggttcagggagagcagaaagtgggacacacagtggctgtgcactctggagctggagtc
cacatcacggggagctgtgtctgtggctccagcatgatgcccagtgtcctgaggctgaatcacagctgcaggaagagccagtc
ccagagaccatgtgtccagagtccctgctctttactccacgtctatgctccaaaggtcaatccatttggagtctttcattaacattcca
gtgggagtcactcaggctgcatacagagtgctggacagagcccacttacaggctttcccatacttgtactgaaatgcaccctgga
agacagtagatgatggatctgttatgaggccccatcaccaagaagggaacactgatgcagttccatgatcctgggttccagctgc
caaaccttgagtacactgcctttatttatcatctccataaaacattggcaaacacaacaccagtattcagagatctgaatcttcatgac
tggccattgttcatccttttatcccatgtaggtagcatcacatattatgtgtcttcctggcctggatgcttagcagagtgtactttactg
acatattatcctaggcacattattctccgggatcatccaagttgtccaaaattacagaatttcttactctgtactgcttgtaaccttccttt
taaaatgtaactttgtccatttctttcattttccattcttgctttcatgagatgtcactggatcacatgtgtgaactcttttgaatgacggtg
ctttaaatgaacaaggaactgcagaggtgtttgccacagtgactgtagattccgtggacacctccctgggatttcatattcattgtac
catgcaatggtgcttgaagatcatgtaataattctgtttctagtttttgatgcttttccataatggttttactaattaacctgacacagactt
gtaccagggttatcatctctctacctccataaaacatgtcagctctggtatgtctgataatagccattctaataggaaggatgcgat
gtctcgttgtgcttctaacatggacatacatgatggtcccagatttgtagcatttttatatgtttgtctttatatcttcttttaaaatttataggt
gtaccataaaattttaaaatttatcattttatttaaaaatttgtctttatgtatttgtccaaaaccacaaagagactgagactgacagtgatc
ttctaactcctgggtcacttccccaatggctacaaaagcttcagctgggtcaggtgacagccaggtgcttggaattctgtccaggg
ctcccacgtgggactacttggaacttcacctacggcctcccagaggggcttaggaaggaatatgacactggaaccaaactagg
acacagcactcagcatcctcatacaggagcaggaatccatcaggctcactccagtgctgctcctgtcaccaccttatcatcactgc
atttaaggaattgatttcttcccttgggattcagttacttgagatctttgaacattaggaaataggctcctaatcatatgtataatcttcaa
tttattttaagtatctattttattttagagacagtgttatagcaagagatgaagagaccaacggatggagagagaagcttctgtccagt
ggttcactttgtaatggctgcaaaggctatgatggctgagcaagaaaccaggagcctggaacttcctctagtttcccacagggc
tggaaggggacaaacacttgggtcatggtagacagtgatcaccattgcaatgcctacctctgtgagttcaattgtggactgcatat
acaaataatgtcacatactatgtgtccacatctacctggattatatcttttagtatgtatactccaagctgacccatgtttcctactgaca
gaacgacctccttcttaacactgaataatatccatgtccaagtgttaaagaatccattcactgttttatgcgcacttgttctttgtagact
gaactattgggaacacagctgcattacctgaacccaggactacgggtgaattgtgacacagtgacttctacccagtgcttgagct
gaactcagagccatgattacagaacagggaagaggggggaacacagggcagctgataacaggacacaaagcaccactcaca
ggaaggaataattctgcccacaccacagtgggctgactcagttcaccacaacacacgacaggttccacaaataactagaactga
ggtctccaggcctcccaacagagtgatggaaaggaggtggaaatgtgcatgacactgagttcatctgtgcccatttctaccatgc
acattccaggagcacataaaccccactaccatgtacagtgttctgtgttcaggaacagttttaaactaaggcaatggatgaataaat
gaacaacacatagttaaccttaaaaaatccacttcagtctttcatctatttaaaagttggtgacaggcactaggacaaaattggctaa
gtccccactagggacaccgtgttcccatcagagaactgactgagcctagcctcacggcttcccacacttttccctcataatgcaa
catgggaacctgtagatgacgctacaagcaaaggagcccctaccaccaacgtttgaattacagacacagtttcttgctccaggg
tcagaaagactaactcctaggggtcataggcatttgggatgtatggggctgtcaacccaaaggcagaaatctcccattgtcacaa
ttctgtccaactctacatttctgtaactctcaccccttctctctctatctctgtcccaatgtctttcatatagatgataaggaactaaagg
ttatttaaataaatgaggaacatgatattgctaacactggatattaagggtacacattgaattaagatgaaataatgtatttgtcttcaa
cttttaaaataatgataacataaaaattcacatgatctgaattttatcacagccatcagcgtacaccccaggtcaccacatctgcc
ctgggccctgtcctgtctgaggcatctgaccccatgcctgttattagcagcagcacatgcaaatggggcctccctctgcccatga
aaaccagcccagccctcaccctgcagctctggcacaggagctccagccccaggactccaggtgtccactcagtgatcgcact
caacacagacgctcaccatggagactgggctgcgctggcttctcctggtcgctgtgctcaaaggtaatgatggagaacgcggg
gcactgagtctgggagaggatgtgagtgagagacacagagagtgtgagtgacagtgtcttgaccatgtcgtctgtgtttgcaggt
gtccagtgtgaggtgcagctggtggagtctgggggaggcttggtccagcctggggggtccctgagactctcctgtgcagcctct
ggattcaccttcagtagctatgctatgcactgggtccgccaggctccagggaagggactggaatatgtttcagctattagtagtaat

Figure 13c Unit 3 13971bp Seq ID 191 (con't)

ggggggtagcacatattatgcaaactctgtgaagggcagattcaccatctccagagacaattccaagaacacgctgtatcttcaaat
gggcagcctgagagctgaggacatggctgtgtattactgtgcgagagacacagtgaggggccctcaggctgagcccagacac
aaacctccctgcagggatgcgcggctccagcagggggcgctcaagacgcactgattgcagattctgatcttgcacaggcgcag
aaggagatgaagccctggtttcctgtcagggatttgggtttcctctcctgtaacagttttgagggaagaattctacttttttattctgt
ccctcaaacttcaatgacggggagaaagtttgatgtaaaaggaagaagtcctaaatgaacaatttggttcatggacagcgactgt
gctcaccaaagtcagagatgtgggaatattgaggactctattgagtctcttccaacctgactcaggacagcaccctcagggcact
gaaagctttggacagtttcagttttccctgtataaccagggacagccgagacagggccgttgatctgttaaacagcaactattcca
ctcatccctctcctgccacaaccagcaagtgtgcactgaaccaactttgactctacatgtgtgatccacactcactttctgcaga
ctttaacccgacctgcatttccctttaatcctggaacagtctgtggtccctgtgtgaacgtcacaacactcaggaatgtactgctgct
cagctgtgtctcaggctgagcttctgcaggcacctgggaagcctacagggacttcctcatcctctaggtcctgggaccctcctgt
gggctccctgcctgaactcaggagggaaatgcactggacatcagcagtcaaggtcatcactgaatggaaagtgttgggtgtgca
cttccggctgatctggttctgctccagtgtcatgggacccccctgcacctgctgtggttcagggagagcagaaagtgggacacac
agtggctgtgcactctggggctggagtccacatcacggggagctgtgtctgtggctccagcatgatgcccagtgtcctgaggct
gaatcacagctgcaggaagagccagtcccagagaccatgtatccagagtccctgctcttctctccatgtctatgctgactggcgtc
atcaatgtattttcagtctttcatcagttttagagagggagacacccaggctgcatatcagagtcctggacagagcccatttacacat
ttctcatacttgtactgacagtgcaccctggaagacagtagatgatggatctgttatgaggccccatcaccaaggtgggaacactg
atgcagttccatgctcctgggttccagctgccaagccttgagtacactgcctttatttatcatctccataaaacattggcaaacacaa
caccagtattcagagatcttaatcttcatgttttgcctcagttcaccacaacccatgacatgttccaccaataactagaactgaggttt
ccaggcctcccaacagagtgatggaaaggaggtggaaatgtgaatgacactgagttgatctgtgaccatttctacaacacacag
attccaatagcacactacaccccactaccatgtacagtgttccgtgttcaggaacagttttaaactaaagcagtgaatgaataagg
gaacaaatcatagttaaccttaaacaaatccacttatagtctttcatctgtttaaaagtgggtggcaggcattaggacaaaattggct
aagtccccgctagggacacccatgttcccatcagattgttgcttgagcccatcctcacagtttccaatacttttcctgataatacatc
ttgggaaactgtagatgacgctacaagtgaatgagaccctaccaccgatgtgggacacacagttttctgctccaggttttagaaag
tctaactcctagatgtctcaacattcatgtttctctcactccttctctctctgtcgctgtttcaatgtcattagaatagttaataatgaacca
atggttattttaaaaatgaaggacatgatactgctaacattggatataaagagtacaaacattaaagtgaaatgaggtattgccttca
aatgtttaaaaataataacataaaatttgccttgatctgaatcctatcatagccatcaccccacaccaccaggacacccacatctgc
cctaggcacagtcctgtctgaggcatctgaccccatgcctgctatataggggcagcacatgcaaatagggcctccctctacccat
gaaaaccagcccagccctcaccctgcagctctggcacaggagctccagccccaggactcccaggtgtccactcagtgattgca
ctcaacacagacgctcaccccatggagactgggctgtgctagcttctcctggtcgctgtgctcaaaggtaatgatggggaacgc
ggggcactgagtctgggagaggatgtaagtgagagacacagagagtgtcagtgacagtgtcctgaccatgtcgtctgtgtttgc
aggtgtccagtgtgaagtgcagctggtggagtctggggagtcgtggtacagcctggggggtccctgagactctcctgtgcag
cctctggattcacctttgatgattataccatgcactgggtccgtcaagctccggggaagggtctggagtgggtctctcttattagttg
ggatggtggtagcacatactatgcagactctgtgaagggccgattcaccatctccagagacaacagcaaaaactccctgtatctg
caaatgaacagtctgagaactgaggacaccgccttgtattactgtgcaaaagatgacacagtgaggggccctcaggctgagcc
cagacacaaacctccctgcagggagtgcggctccaccagagggcgcgcaagacgcactgagcacagattctggtcctgctc
aggcgcagagggagatgaagccctggtttcctgtcagggatttgggtttcctctcctacagttttgagggaagaattctccttttatg
actctgtcccttcctttgacttcactgacgtagagaagtttgaagtgacaggaagaagtcctaaacggacacattcaggtttgtgaa
cgatgacagtggtcaccaggatcagagatgcaggactatctggggacctcgtgagtgttgtccagtctgactcaggacagcgtt
ccaggacactgccgactataagacaattttggttttccttcaaacccagacagacccgagccagagtcttgatttgctacctcagttt
tataagtcgtcccatcctcctgtcagagcagcctgtgtgctgaactgaaccaaccgtcttatttaaactgtgggtgttctgcattcac
tttctacagactttatacccaatctccatttcccttaatcctggaacagtctgtggtccctgtgtgcacttccagctgatctggttctgc
tccagtgtcatgggacccccctgcacctgctgtggttcagggagagcagaaagtgggacacacagtggctgtgcactctggggc
tggagtccacatcacggggagctgtgtctgtggctccagcatgatgcccagtgtcctgaggctgaatcacagctgcaggaaga
gccagtccaagagaccatgtgaccagagtccctactcttctctccatgtctatgctgactggcgtcatcaatgtattttcagtctttca

Figure 13c Unit 3 13971bp Seq ID 191 (con't)

tcagttttagagagggagacacccaggctgcatatcagagtcctggacagagcccatttacacaataccacacttgtaactgaca
atgcaccctggaagacagtagatgatggatctgttatgaggccccatcaccaaggtgggaacattgatgcagttccatgcttctg
ggttccagctgccaagccttgagtacactgccttcatttatcatctccataaacattggcaaacacaacaccagtattcagagatca
atcgtcatgattggccatcattgctatttcatattcctaaatgtttgataaataatattgagtatagctctatgaagtacaatgatatgtgt
ggtcaaaatgaatgcatactgagaggaattgtgaagtcagacttgatgacacattcataccacaacacatgttttggtggagttca
cctgtctcctgctcttaagagatttctactcacaatattctcttaacctctgtcaccatgctgtgcagtagatccctcagtgtgtggagc
ctgtgggactgaaactctgaccttgctccagcgtctcctctgttcctccctcgctcagactttggtcttcaccattgtactttctgcctct
gtgagttcagccttttatcccatgtaggtagcatcacatattatgtgtcttcctggcctggatgcttagcagagtgtacttttactgaca
tattatcctaggcacattattctccgggaccatccaagttgtccaaaatcacagaatttcttactctttactgcttataaacttccttttaa
aatataactttgtccatttctttcataatccattcttgcttccatgagatgtcactggatcatatgtgtgaactcttttgaatgacggtgctt
taaatgaacaaggaactgcagaggtgtttgccacagtgactgtagatcccgtggacacctccctgggatttcatattcattgtacca
tgcaatggtgcttgaagatcatgtaataattctgtttctagttttgatgcttttccataatggttttactaattaacctgacacagacttgt
accagggttatcatctctctctacctccataaaacatgtcagctctggtatgtctgataataggcattctaacaggagggatgggat
gtctcattgtgcttctaacatggacatacatgatggtcctagatttgtagcatttatatgtttgtctttatatcttcttttgaaatttatagat
gtaacataaattttaaaatttatcattttattggccagcgcatggctcactaggctaatcctccacctgcggcaactgcactccgggtt
ctagtctcggtcgggcgctggattctgtcctggttgcccctcttccagtccagctctctactgtggcccaggagcgcagtggagg
atgatccaagtgcttgggccctgcacccgcttggagaccaggagaagcacctggctcctggctacggatcagcgcggtgcag
cggctacagcggccattggagggtgaaccaacggtaaaggaagacattgctctctgtctctctcactgccactgtccactctgcc
catcaaaaaaatttatcattttatttaaaaatttgtctgtatgtatttgtccaaaaccacagagagactgagactgacagtgatctccta
actcctgggttacttctcgatggatacaaaattcagctaggtcaagcgacatccagttgcttggaattctgtccagggctccacgtg
ggactacttggaacttcacctacggcctcccagaggggcttaggcaggcatctgaaaccggaaccatactaggacacagcact
aagcatcctgacacgggaggcaggaatccctcaggctcactccagtgctgctcctgtctccaccttatcatcactgcatttaagga
attgattcagttgcttgagatctttcaacattgggaaataggctcctaatcatatgtataatcaatcttcaatttactttaagtatctatttat
tttattttaagacagtgttatagcaagagaggaagagaccaacagatggagggagaattccatccactggttaacttcctgaatgg
ctgcaaaggctagggatggctgagcctaaagtcatgagcttggaacttccaccagtttcccacagggaggaagggggacaaacc
cctggttcatggtagacagtgatcaccattgctcttcttatctctgtgagttcaacttgtggagttcaacttgtgcatgtataactaatgt
cacatactatgtgtccacatctacctggattatttctgttagcatattatgctccaggctgacccacgtttcctaatgacagaacaacc
tccttcttaatactgaataatattctatgtccaaatgtgaaataatccattcactgtttaatgcacacttgatttattgtagactgaactatt
atgaacaaaactgcattacctgaacccaggactgcgggtgaattgtgacacagtgacttctacccagtgcttgagctgaactcag
agccatgattacagaatagagaagacagtggaacacagggtggctgataccagggcacaaaacaccaccaaaggcaggaat
aattctgcccacaccacagtgggctgactcagttcaccacaacccacgacaggttccacaaataactagaactgaggcctccag
acctccaaacacagagtgatggaaaggaggtggaaatgtgcctgacactgagttcatctgtgcccatttctgcatgcacattccaa
tagcacacaaaccccactaccatgtacagtgttctgtgttcaggaacagttttaaacagtttaaacagttttttaaattttaaggcaatg
atgaataaggaaacaaaacatagttatcctaaagatatccacttgcagtccttcatctgtttaaaagtgggcgacagccattaggac
aaaattggctaagtcaccactagggtcacccgtgttcccatcagagaactgactaagcccagcctcacggcttcccacactttcc
ctcataatgcatcatgggaaactgcaggtgacactaagagcaaatgaggccctaccactgacattggaattacagtcacattttctt
gctccagggttcagaaagactaactcctaggggtcataggcatttgggatgtctgggctgtcaacccaaaggcagaaatctcc
ctttgtcacctttctgtccatctctacatttctgtatctctcacccccttctctctctatcactgtcccaatgtctttcatatagatgataagg
aactaatggttatttaaataaatgaaggacatggtattgctaatactcgatatgaagggcacacacatattaaaatgaaacaaagtat
tttcctttaacttttaaaataatgataacataaaaattcatatgatctgaatcttatcacagccatcaccgtacaccccaggtcacca
catctgccctgggccctgtcctgtctgaggcgtctgacccatgcctgctatataggggcagcacatgcaaatagggcctccctc
tgcccatgaaaaccagcccagccctcaccctgcagctctggcacaggagctccagccccaggactcccaggtgtccactcagt
gatcgcactcaacacagacactcaccatggagactgggctgcgctggcttctcctggtcgctgtgctcaaaggtaatgatggag
aacgcggggcactgagtctgggagaggatgtgagtgagagacacagagagtgtgagtgacagtgtcctgaccatgtcgtctgt

Figure 13c Unit 3 13971bp Seq ID 191 (con't)

gtttgcaggtgtccagtgtgaggtgcagctggtggagtctgggggaggcttggtacagcctggggggtccctgagactctcctg
tgcagcctctggattcaccttcagtagctatagcatgaactgggtccgccaggctccagggaaggggctggagtgggtttcatac
attagtagtagtagtagtaccatatactacgcagactctgtgaagggccgattcaccatctccagagacaatgccaagaactcact
gtatctgcaaatgaacagcctgagagccgaggacacggctgtgtattactgtgcgagagacacagtgaggggccctcaggctg
agcccagacacaaacctccctgcaggggagtgcggctccaccaggggggcgcgcaagacacactgagtccagattctggtcct
gctcaggcacagagggagatgaagccctggtttcctgtcagggatttgggtttcctctcctacagttttgagggaagacttctactt
caggattctgtcccttacactgacgccactgacgtagagaagctttatgtgacaggaagaagtcttaaatggacacattcaggtttg
tgaacgatgacagtggtcaccagggtcagagatgtgagacaatcaggggacctcgtgagtgttgtccagtctgactcaggaca
gcgttccaggacactgccgactataagacaattttagttttccttcaaacccagacagacccgagccagagtcttgatttgctacct
cagttttataagtcgtcccatcctcctgtcagagcagcctgtgtgctgcactgaaccaaccgtcttatttaactgtgggtgttctgca
ttcactttctacagactttatacccaatctccatttccctttaatcctgaaacagtctgtggtccctgtgtgcacttccagctgatctggtt
ctgctccagtgtcgtgggaacccctgcacctgctgtggttcagggagagcagaaagtgggacacagagcggctgtgcactctg
gggctggagtccacatcacggggagctgtgtctgtggctccagcatgatgcccagtgtcctgaggctgaatcacagctgcagg
aagagccagtcccagagaccatgtgtccagagtccctgctcttcactccatgtctatgctgactggggtcatcaatccatttgtgttc
tttcatcagtattagagagggagacacccaggctgcatatcacattgctggatggagcccatttgcacgctttcccatacttgtact
gacagtgcaccctggaagacagtacatgatggatctgtatgaggccccatcaccaaggtgggaacactgatgcagtttcatgct
cctgggttccagctgacaagcttgagtccactgcctttatttatcatctccataaaacatggccaacacaacaccagtattcaaagat
caatcgtcatgattggccatcgttgctatttcatattcctaaatgtttgataaataatattgagtatagctctatgaggtacaatgatatgt
gtggacaaaatgaatgcatattgagtggaattatgaagtcaggcttgatgacacattcataccacaacacatgtttttggtggagttc
acctgtctcctgctcttaagagatttccactcacaatattctcttaacctctgtcaccatgctgtgcagtagatccctcagtgtgtgga
gcctgtgggactaaaactctgaccttgctccagcgtctcctctgttcctccctcgctcagactttggtcttcaccattgtacttcctgc
ctctgtgccttcagcctttatcccatgtaggtagcatcacatattatgtgtcttcctggcctggatgcttagcagagtgtactttactg
acatattatcttaggcacattattctccgggatcatccaagttgtccaaaatcacagaatttcttactctgtactgcttttaaacttcctttt
aaaatgtaactttgtccatttctttcattttccattcttgcttccatgagatgtcactggatcatatgtgtgaactcttttgaatggcggtgc
tttaaatgaacaaggaactgcagaggtgtttgccacagtgactgcagatcccgtggacacctccctgggatttcatattcattgtac
catgcaatggtgcttgaagatcatgtaataattctgtttctagttttttgatgcttttccataatggttttactaattaacctgacacagactt
gtaccaggggttatcatctctctctacctccataaaacatgtcagctctggtatgtctgataatagtcattctaacaggagggatggga
tgtctcattgtgcttctaacatggacatacatgatggtcctagatttgtagcattttatatgtttgtctttatatcttcttttgaaatttatagat
gtaacataaattttaaaatttatcattttattggccagcgcatggctcactaggctaatcctccacctgcggtgacttaccgttcgtata
gcatacattatacgaagttatggccggccacgcgt

Figure 13d Unit 4 15445bp Seq ID 192 gcgcgccgcgatcgcgaagttcctattccgaagttcctattctctagaaagtataggaacttcagggcgcgaggctcttctaggg
ggcgcacaagacgcactgagcccagattcctgtcctgcacaggcgcagagggagatgaagccctggtttcctatcagggaatt
ggggtttgctgtcctgtaacagttttgagggaagaattctacttttttgattctgtccctcccaacttcaatgacggagagaaagtttga
tgtaaaaagaagaagtcctaattgaacaatttggttcatggacagcgactgtgctcaccagggtcagagatgtgggaatattgag
gacactattgagtctcttccaacctgactcccgacagcaccctcagggcactgaaagctttggacagtttcagtttccctgtataac
cagggacagccgagacagggtcgttgatctgttaaacagcaactattccactcatccctctcctgccacaaccagcaagtgtgca
ctgaaccaacttttgactctacatgtgtgcgatccacactcactttctgcagactttaacccgacctgcatttcccttttaatcctggaac
agtctgtggtccctgtgtgaacgtcacagcactcaggaatgtacttgcagctcagctgtgtctcgggctgagcttctgcaggcacc
tgggaagcctacagggacttcctcatcctctaggtcctgggaccctcctgtgggctccctgcctgaactcaagagagaaatgtgc
tggacatcagcagtcaaggtcataactgaatggaaagtgttggatgtgcacttccagctgatctggttctgctccagtgccatggg
accccctgcacctgctgtggttcagggagagcagaaagtgggacacacagtggctgtgcactctggagctggagtccacatca
cggggagctgtgtctgtggctccagcatgatgaccaatgtcctgaggttgaatcacagctgcaggaagagccagtcttagacca
tgtgtccagagtccctgctcttcactccatgtcatgttgactggagttatcactccactttagtctttcatctatttagagagggagaca
tccatgctgcacatcacattgctggatggagcccatttacacatttcccatacttgtactgacagtgcaccctggaagacagtagat
gatggatctgttatgaggccccatcaccaaggtgggaacactgatgcagttccaagctcctgggttccagctgccaagccttgag
tacactgcctttgtttatcatctccataaaacattggccaacacaacaccagtattcagagatctgaatcttcatgattgatcatcgttg
ccatttcatatttataaatgtttcataaataagaattcattatagctctatgaggtacaatgatatgtgtggacaaaatgaatgcatattg
agtggaattatgaactcagacttgctgacacgttcatacctcaacacatgttttggtggagttcagctgtctcctgctcttaggagat
ttccaaacacagtattctcttaacctctttcaccatgctgtagagtagatccctcagtgtgtggatcctgtgggactggaactctgac
cttgctccaccattctctgctcctccctcactcagactttggtcttcaccattgtacttcctgcctctgtgagttcagcctttttatcccgc
ataggtagcatcacatattatgtgtcttcctggcctggatggttagcagtgtgcacttttactgacatattatcctaggcacattattctc
caggatcatccaagttgtccaaaattacagaatttcttactctactgcttataaacttccttttaaaatgtaacttttttccatttctttcatttt
ccattcttgctttcatgagatgtcactggatcacacgtatgaactcttttgattgatggtgctttaaacgaacaaggaactgcagaggt
gtttgccacactgactgcagatcccgtggacacctccctgggatttcatattcattgtaccatgcaatggtgcttgaacatcatgtaa
taattctatttctagttttttgatgcttttccatacggttttactaattaacctgacacagacttgtaccagggttatcatctctcttacctata
aaacatgtcagctctggtatgtctggtaatagccattcaacaggagcgatgggatgtctcattgtgcttctaacatggacatacatg
atggtcccagactgataacatttttatttgtctgtctatatatcttcttttaataatttatagaaatgatataattttaaaatttatcattttattta
aaaatttgtctgtatgtatttgtccaaaaccacaaagagacggagactgacagtgatcttctaattcctgggtcacttccccaatggc
tacaaaagctttagctggatgaggcaacagcctggttcttggaattctgtccatgtgtccgcatgggactacttggaacctcaccta
tggcctcccagggtgtgcttaggcaggaatctggaactggaaccaaactaggacgcagcactaagaatcctgacacgggagg
caggaatccctcaggctcactccagtgctgctcctgtcaccaccttatcagtcactgcatttaaacaattgatttcttcccttgggatt
cagttgcttgagatcattcaacattaagaaacaggctcctaatcatatgtataattaatcttcaatttatttttaagtatctatttattttatttt
aaagtcagtgttatagcaagagaggaagagaccaacagatggagggagaatcttccttccacaggtttccgtctgaatggctgct
aagactgaagatggctcagccagaaaccaggagcctggaacttcctccagtttcctacaggggttggaagggacaaacacttg
ggtcatggtagacagtgatcaacattgcactgcctacctctgtgagttcaatcttgtggactgcatatataactaatgtcacatactat
gtgtctacgtgtaccgggattatttctgttagcatattgtgttccaggcagacccacgtttcctattgacagaatgacctccttcttaat
actgaataatattctatgtccaaatgcgaaagaatccattcagtcttctatgcacacttgctttattgtagactgaactattgggaacaa
agctgcattacctgaacacaggatggcggctcaattgtgacacagagacttctacccagtgcttgacctcaactcagagtcatgat
tactagacacagagaagagaggggaacaggggaaggctgataccaggacacaaagcaccactcacaggaaggaataattct
gcccacaccgcagtgggctgactcagttcaccacaacacacgacaggttccacaaataatgagaactgaggtctccaggctgc
ccaactcagagtgattgaaaggaggtggaaatgcgcatgacactgagttgatctgtgcccatttctaccatgcacattccagtagc
actctataccccactaccatgtacagtgttctgagttcaggaacagttttaaacagtttaaatagttgttaaactttaaagcaatggag
gaagaaggaaacaaaacatagttaaccttaaaaaatccacttgcagtccttcatctgtttaaaagtgggcgacaggcatttggtca
aaattggctaagtccccactagggacacccgtgttcccatcacagaactgactgagcccagcctcacggcttcccacacttttcct

Figure 13d Unit 4 15445bp Seq ID 192 (con't)

cataatgcatcatgggaaactgtagatgacgctacgagcaaaggagccccctaccaccaacgtttgaattacagacacagtttctt
gctccagggttcagaaagactaactcctaggggtcataggcatttgggatgtctggggctgtcaacccaaaggcagaaatctcc
cattgtcacctttctgtccatctctacatttctgtatctctgacccctctctctctatcactgtaccaaggtctttcatatagatgaaaag
gaactaatggttatttaaataaatgagggacatgatattgctaacattggatatgaggggtacacacatattaaaatgaaacaaggt
cattgccttcagtcttttaaaattatgataacataaacattcatatcatctgaatcgtatcatagccatcaccctacacacccaggaca
ccacgtctgccctgggccctgtcctgtctgaggcgtctgacatcatgcctgctatataggggcagcacatgcagatagggcctcc
ctctgcccatgaaaacctgcccagccctcaccctgcagctctggcacaggagctccagccccagcactccaggtgtccactc
agtgattgcactcaacacagatgctcaccatggagactgggctgcgctggcttctcctggtcgctgtgctcaaaggtaatgatgg
ggaaggcggggcactgagtctgggagaggacgtgagtgagagacacagtgagtgtcagtgacagtgtgctgaccatgtcgtc
tgtgtttgcaggtgtccagtgtgaagtgcagctggtggagtctgggggaggcttggtacagcctggcaggtccctgagactctcc
tgtgcagcctctggattcacctttgatgattatgccatgcactgggtccggcaagctccagggaagggcctggagtgggtctcag
gtattagttggaatagtggtagcataggctatgcggactctgtgaagggccgattcaccatctccagagacaacgccaagaactc
cctgtatctgcaaatgaacagtctgagagctgaggacacggccttgtattactgtgcaaaagatgacacagtgaggggccctca
ggctgagcccagacacaagcctccctgcagggacgcgcggctccaccaggggggcgcaaaagtctcactgagcgcagattct
ggttctgcacaggcacagagggagatgaagccctggtttcctgtagggatggggtttcctctcctgcaacagttttgagggaaga
attcttcttttatgattctgtccctgctactgaattcctgacatagagaagtttgaattgacaggagaagtcctatatgaaccaattcag
gttcagtggtctccaggatcagagatgtgggtctatctgggtacaacgtgagtgttgtccactctgagtcaggacaacgctctcag
ggcactgccgactttaggacaatttagattcccttttcgaccaggacagctgaggcagggttcttggtctttataaatcagctattta
agtatctgtagcctgacaaaaagagcaagtgtgctgaactgaaccaacctttgactttacttgtgggtgatccacacaaactttcga
tagactttatgctcgatttctatttccctttaatcctggaacagtctgtggtccctgtgtgaacgtcacagcactcaggaatgtacttgc
agctcagctatgtctcaggctgagcttctgcaggcacctgggaagcctacagggacttcctcatcctctaggtcctgggaccctc
ctgtgggctccctgcatgaactcaggagggaaatgccctggacatcagcagtcaaggtcatcactgaatggaaagtgttgggtg
tgcacttccagctgatctggttctgtctagtgtcgtgtgggaaccccctgcacctgctgtggttcagggagagcagaaagtgggacac
acagtggctgtgcactctggggctggagtccacatcacggggagctgtgtctgtggctccagcatgatgaccaatatgctgagg
ctgaaccacagctgcaggaagagccagtcccagagaccatttgtccagagtccctgctcttcactccatgtctatgctgactggc
gtcatcaatccatttggagtcttagatcagttttagatgggagacacccaggctgcatatcagagtcttggacagagcccatttaca
catttaccacacttgtaactgacaatgcaccctggaagacagtagatgatggatctgttatgaggccccatctccaaggtgggaac
actgatgcagttccaagctcctgggttccagctgccaagcctgagtcaactgccttcatttatcatctccataatactttggcaaaca
caacaccagtattcagagatctgaatcttcatgatgggccattgttgccatttcatattcataaatattttataaataagaattgagtata
cctctatgaggtacaatgatatgtgtggacaaatgaatgcatattgagtggaattatgaagtcagacttgatgacacattcataccg
caacacatgttttggtggagttcagctgtctcctgcttttaggattttccactcacaatattcccttaagctctgtcaccatgctgtgca
ggagatccctcagtgtgtggatcctgtgggactgaaactctgaccttggtccaccatcacctctgttcctccctcactcagactctg
gtcttcaccactgtacttcctgcctctgtgccttcagcttttttcccacataggtagtatcacatatatgtgtcttcctggcctggatgg
tgagcagagtgtacttttactgacatatattcctaggcacattatctccaggatcattaaagttgtccaaaattacagaatttcttactc
tactgcttataaacttccttttaaaatgtaactttgtccatttctttcatttccattctttcttccatgagatgtcactggatcatatgtgtact
cttttaaatgaacaaggaactgcagaggtgtttgccactgtgactgcagatcccgtgaacacctccctgggatttcatattcattgta
ccatgcaatggtgcttgaacatcatgtaataattctatttctagttttttgatgcttttccatacggttttactaattaacctgacacagactt
gtaccagggttatcatctctctctacctccataaaacatgtcagctctggtatgtctggtaatagccattctaacaggagcgatggga
tgtctcgttgtgcttctaacatggacatacatgatggtcccaaattgatagcattttatatgtctgtctatatatcttcttttaataatttata
gaaatgatataattttaaaatttatcattttatttcagaccttgtctttatgtatttgtccaaaaccacagagagtgagactgacagtgatc
ttctaattcctgggtcacttccccaatggctacaaaagcttcagctggatgaggcaacagcctggtgcttggaattctgtccatgtgt
ccgcatgggagtacttggaacctcacctacggcctcccagggtgtgcttagcaggaatctgaaactggaaccaaactaggaca
cagcactaagcatcctcacatgggaggcaggaatcccacaggctcactcaagtgctgctcctgtcaccaccttatcatcgctgtat
gtacacaattgatttcttcccttgggattcagttgtctgtgttcattcaacattaacaaacaggctcctaatcatatgtataattaatcttc

Figure 13d Unit 4 15445bp Seq ID 192 (con't)

aatgtattttaagtatctatttattttattttaaagacagtgttatagcaacagaggaagagaccaacagatggagggagaattccttc
catttgttcacttcctgaatggctgccaaaggctggggatggctaagcctaaagtcaggagcctggaacttcctctagtttcccaca
gggctggaaggggacaaacatggttgacagtgatcaccattgcacttcctacctctgtgagttcaacttgtggactgcatatataa
ctaatgtcacttactatgtgtccacatgtacttgcattatttcttttagtttgtatgctccagggagacccacatttcctaatgacagaac
aacctccttcttaatactgaataatattccatgtccaaatgggaaagaatgcattcactgttttatgcgcacttgctttgtttgagactga
agtattgtgaacaaagctgcaacctgacacaggactgggggtaaattgtgacacagtgacttctacccagtgcttgagctgaact
cagagtcatggttactagacacagggaagaggggggcaacaggggggacggctgataccaggacacaaagcaccactcacagg
aaggaataattctgcccacaccacagtgggctgactcagttcaccacaacacacgacagattccacaaataactagaactaatgc
gtccaggctgcccaactcagagtgattgaaaggaggtagaaatgtgcatgacactgagttgatctgtgcccatttctaccatgcac
attccaatagcactctatacccactaccatgtacagtgttctgtgttcaaaacagttttaaaccatttaaacagttttttaaactttaagg
caatggatgaataaggaaacaaaacatagttaaccttaaaaaatgcacttgcagtccttcatctgtttaaaagtgggtgacaggcat
taggagaaaattggctaagtccccactagggacaccggagttcccgtcagagaactgactgagcccagcctcacggcttccca
cacttttccctcataatgcatcatgccaaactagatgacactacaagaaaatgagcacctaccactgacgttggaattacagacata
gtttcttgcttcagcgttcagaaagactaactcctagatgtcataggcatttgggatgtctggggctgtcaacccaaaggcagaaat
ctcccattgtcacctttctgtccatctctacatttctgtatctctgaccccttctctctctatcactgtcccaatgtctttcatatagatgat
aaggaactagtggttacttaaataaatgagggacatgatattgctaacactggatatgagggtaaacacatattaaaatgaaacaa
ggtcattgccttcaacttttgaaattatgataacataaaaattcatatgatctgaatcatattatagtcatcaccctacaaacccaggtc
acctaattctgccccaggccctatcctgtctgaggcatctgaccccagggctgctatataggggcagcacatgcagatagccctc
cctctgcccatgaaaaccagcccagccctcaccctgcagctctggcacaggagctccagccccaggactcccaggtgtccact
agtgatcacactcaacacagacgctcaccatggagactgggctgcgctggcttctcctggtcgctgtgctcaaaggtaatgatgg
ggaacgcggggcactgagtctgggagaggacgtgagtgagagacacagagagtgtgagtgacagtgtcgtgaccatgtcgtc
tgtgtttgcaggtgtccagtgtcaggtgcagctggtggagtctgggggaggcgtggtccagcctggggaggtccctgagactctc
ctgtgcagcctctggattcaccttcagtagctatggcatgcactgggtccgccaggctccaggcaaggggctggagtgggtggc
agttatatcatatgatggaagtaataaatactatgcagactccgtgaagggccgattcaccatctccagagacaattccaagaaca
cgctgtatctgcaaatgaacagcctgagagctgaggacacggctgtgtattactgtgcgagagacacagtgaggggccctcag
gctgagcccagacacaaacctccctgcagggccgtacgtctccaccaggaggcacacaagatgcactgaatatatattctggtc
atgggtaggtgtagagggacaataagccctggtttccttttagggaattgggggtttcctctcctctaatacatttgaagaaatggttct
actcttacgattctgtccctgccactgacttcactgacggatagaaactttgaatagaaggaagaagtcctacgtgacaatttcggg
ttcatgactgacaactatcctcaccgcgatcagatatcatggggatctgtgaggacctcgtgagtcttttccagtctaactcgtgctg
gtgtcctcagggcgctgccgactctaggacaattttacttttcccttttatatcctggagacaactgagccagggtctctggtctgtta
aacctcaactatttccctctcttcctgtcaaagtagcctgtgtgcggaactgaattgacattttatttttaaactgtgggtgatccacact
cactttctgcagaatgtggccacctttaatcctggaacagtctgtggtccctgtgtgaacgtcacagcactcaggaatgtacttgca
gctcagctgtgtctcagactgagcttctggaagcacctgggaagcctacagggacttcctcatcctctaggtcttgggacactcct
ggggggctccctgcctgaactcggaggggaaatgcactggacatcagcagtcaaggtcatcactgaatggaaagtgttgggtg
tgcacttctagttgatctgattctgttgagtgttgtgggactccctgcacctgctgtggttcagggagagcagaaagtgggacacac
agtggctgtgcactctggggctggagtccacatcacggggagctgtgtctgtggctccagcatgatgaccagtgtcctgacgct
gaatcacagcttcaggaagagcaagtctcggagaccatgtgtccagagtccctgctcttcactccatgtctatggtgactggggtc
atcaatgcatttggagacttccatcagtattagagagggagacacccaggctgcatatcagagtgctggacacagcccatttgca
cactttcccagacaagtaactgacagtgcaccctggaagtcagtagatgatggatgtgttatgaggccccatcacgaaggtggg
aacactaatgcagtttcaagctcctgggttccagctgccaagcttcagtccactggaatttatttatcatctccataaaatattggaaa
atactggaaagcactacaccagtattcagagtgttgaatctccatttttgatcatttaatcatttcctttacataagtgtttgatatataata
ccaaaacatagacatatgaggtacaatgatatgtgttgataaataaatgtatcaaattgagtttttatgaagtcagacttattgacatg
ctcatcagaaaaccacatgtttccatggtagaatgtcagttgtctgctgttttggaattctttaggcacaatattcccttcactgctgtg
accatgctgtacagtagatcctcagtgtatggatcctgttggactggaactctgaccttgctccaacgtctcctctgctcctcccttg

Figure 13d Unit 4 15445bp Seq ID 192 (con't)

ctcagacgttggtcttcaccatcgtacttcctgcctctgtgacttcatcctttatcccatgtatccagcatcacgtattatttgtcttcttg
tcctgcatggttagcagagtgtacttaccctgacacattatccttggacattattctccaggatcatccgagttgtccaaaatacaga
atttcctcatctgtactgccatataaacttcctgttaaatataattttgtccatttgttccattgttgattctttcttcatgaatatttcactgga
ttgtatgtgtgaactcttgtgaatgatgctgcattagttgaacatggaagagcagaggtgtttgccacattgattgcggttccctgg
acacctccctgggatttcatattccttctactcaaaattggtgtttgaagatcctgtgataattctgtttcagttttgatgaatttccataat
aatttacttgtttacctgactccattcttgcaccagagttatctccagcttcctccacatggattgtcagctctggattgtaggataata
ctcattctaacaggaaggatgggatgtctcattgtgcatctattagggacatgcatgatgggcccaatatatcattttatatgttgcctt
tatatcttttttaaaaagttaaagatactatttcacttatttttgatatttgtatttacatatttttttcaaaaaagcaaagagactgagactga
cagtgatcttctaattcctggtcacttcccagatggatacaaaagcttcagctgggttaggtgacagccatgtgcttggaattctgtc
cagttgtccacatggcagtacttggaacttcacctactgcctcccagaagggcttagacaggaatctgacactggaacgaaacta
ggacacagcactcagcatcctgacacgggaggcaggaatccctcaggctcactccagtgctgctcctgtcaccaccttatcatc
actgcatttaaggaattgattgcttcccttgggatcagtggcttgagttcattcaacatttggaaataggctcctaaccatatgtataat
taatctttcatttattttaagtatttattttatttgaaaggcagtgttatagcaagagagaaagctatcaacagatggagagagaagtttc
tattcactggttcacttcgtgaatggctgcaaaggctgggatggctgagcctgaagccaggagcctggaacttcccccagtttcc
cccagagctggaaggggacaaacacttgggtcatggtacacagtgatcaccattgcacttcctccctctgtgagttcaatcttgtg
gactgcatgtataactaatgtcacatactatgtgtccacatgtacctgcattatttctgttagcatattatgctccaggctgaccaatga
tttcctaacgaccgaacaacctccttcttaacactgaataatattccatgtcaaatgtaacagactgcattcactgttttaggcacattt
cactttattgtagactgaactattgtgaacaaagctgcattacatgaacccaggactgtgggtgaattgtgacacagtgacttctatc
cagtgcttgagctgaactcagagtcatggttactagacacagggaagaggggggaacacagggcagctgataccagggcacaa
agcactcacaggaaggaataattctgcccacactacagtgggctgactcagttcaccacaacccatgacagattccatgaataat
gagaactgaggcctccaggcccctccaactcagagtgtaggaaaggaggtggaaatgtgaatgacattcagttgatctgtgccc
atttctacaacacacagattccaatagcacagtacaccccactagcaagcacagtgttctgtgttcatgacgagtgttaaataagtc
aatggatgaataaggaaacaaaacatagttaacctaaaaagaatccacttgcagtcttttatctgtttaaaagtgggaggcaggcat
taggacaaaattggcaaagtccccactagggacaccggtgttcccatcagaatgaatcattcagccacacgactccccacacttt
ttctgataatgcattttggaaaactgtagatgacactacaagtgaatgagcccctaccactgacgtgggaaacaaatttgcagttttg
cgctccatgttttagaaaggctaagtcctcggtgttgtaggcacttgggatgtttggggctgtcaatcaaaggtggaaatctcccttt
gtcacctttctgtccatctctacatttctcttctctcaccccttctctcactgtcactattccaatgttattcaaatagttaaaaatgaacc
atggttattttaaaaatgaaggacatgataacactggattattaaggatacacacatattaaaatgaaacaaggtcattgccttcaatt
gtttaagcaacaatgataatgtaaagatttctatgatctgaatcctatcatagccatcaacctacaccacaggacaccacatctgcc
ctgggcactttcctgtctgaggcatcagaccccatgcctgctatataggggcagcacatgaaaacagggcctccctctgcccatg
aaaaccagcacaggcctcaccctgcagctctggcacaggagctccagcctcaggactcccaggtgtccactcagtgatcacac
tcaacacagatgctcaccatggagactgggctgcgctggcttctcctggtcgctgtgctcaaaggtaatgatggggaacgcggg
gcactgagtctgggagaggacgtgagtgagagacacagagagtgtgcgtgacagtgtgctgaccatgtcgtctgtgtttgcagg
tgtccagtgaggtgcagctggtggagtctgggggaggcttagttcagcctggggggtccctgagactctcctgtgcagcctctg
gattcaccttcagtagctactggatgcactgggtccgccaagctccagggaaggggctggtgtgggtctcacgtattaatagtga
tgggagtagcacaagctacgcggactccgtgaagggccgattcaccatctccagagacaacgccaagaacacgctgtatctgc
aaatgaacagtctgagagccgaggacacggctgtgtattactgtgcaagagacacagtgaggggccctcaggctgagcccag
acacaaacctccctgcaggggagtgcggctccaccagggtgcgcacaagacgcactgagcccagattctggccctgctctgat
gcagagggaaatgagccctggtttcctgtcagtgatttgtggtttgttctacagttttgcggcaagaattctacttcatgattctgtctg
ttccactgacttcactgacttagagaagtttgatgtgacaggaagaagtcctgaatggacacattcaggttagtgaactatgacagt
ggtcaccagggtcagagatgtgagacaatcaggggacctcgtgagtgttgtccagtctgactcaggacagcgttccaggacact
gccgactataagacaattttagttttccttcaaacccagagagagccgagtcagagcattgattttcaccttaattatataagtcatg
acacatcctgtcggagtagcctgtgtgctgcactgaaccaactgtcttattttaaactgtgggtgttctgcattcactttctacagactt

Figure 13d Unit 4 15445bp Seq ID 192 (con't)

0tatacccatctccatttccctttcatcctggaacagtctgtggtccctgtgtgaacgtcacagcactcaggaatgtactgcagctc
agttgtgtctcaggctgagcttctgcaggcacctgtaccgttcgtatagcatacattatacgaagttatggccggccacgcgt

HUMANIZED IMMUNOGLOBULIN LOCI

CROSS REFERENCE TO RELATED APPLICATIONS

This application claims the benefit under 35 U.S.C. § 119 (e) of the priority of U.S. Provisional Application Ser. No. 60/487,733 filed on Jul. 15, 2003.

Pursuant to 37 CFR 1.821(c) and 1.52(e), this application is accompanied by a compact disc (ie. Copy 1) containing a Sequence Listing saved as file "39691-0007A saved Apr. 4, 2005", created on Apr. 4, 2005, size: 1,491 KB, and one duplicate copy (ie. Copy 2), in lieu of a paper copy of the Sequence Listing, the entire contents of which are hereby expressly incorporated by reference.

FIELD OF THE INVENTION

The present invention concerns methods and means to produce humanized antibodies from transgenic non-human animals. The invention specifically relates to novel immunoglobulin heavy and light chain constricts, recombination and transgenic vectors useful in making transgenic non-human animals expressing humanized antibodies, transgenic animals, and humanized immunoglobulin preparations. The transgenic vectors contain humanized immunoglobulin loci, which are capable of undergoing gene rearrangement, gene conversion and hypermutation in transgenic non-human animals to produce diversified humanized antibodies, while leaving the endogenous regulatory and antibody production machinery of the non-human animals essentially intact. The humanized antibodies obtained have minimal immunogenicity to humans and are appropriate for use in the therapeutic treatment of human subjects.

BACKGROUND OF THE INVENTION

Antibodies are an important class of pharmaceutical products that have been successfully used in the treatment of various human diseases and conditions, such as cancer, allergic diseases, prevention of transplant rejection and host-versus-graft disease.

A major problem of antibody preparations obtained from animals is the intrinsic immunogenicity of non-human immunoglobulins in human patients. In order to reduce the immunogenicity of non-human antibodies, it has been shown that by fusing animal variable (V) region exons with human constant (C) region exons, a chimeric antibody gene can be obtained.

Humanized monoclonal antibodies have also been developed and are in clinical use. Humanized monoclonal antibodies are typically human antibodies in which some CDR residues and possibly some FR residues are substituted by residues from analogous sites in non-human animal, e.g. rodent, antibodies. Humanization can be essentially performed following the method of Winter and co-workers (Jones et al., *Nature,* 321: 522 (1986); Riechmann et al., *Nature,* 332: 323 (1988); Verhoeyen et al., *Science,* 239: 1534 (1988)), by substituting non-human animal, e.g. rodent, CDRs or CDR sequences for the corresponding sequences of a human monoclonal antibody.

It has been described that the homozygous deletion of the antibody heavy-chain joining region (JH) gene in chimeric and germ-line mutant mice results in complete inhibition of endogenous antibody production. Transfer of the human germ-line immunoglobulin gene array in such germ-line mutant mice will result in the production of human antibodies upon antigen challenge. See, e.g., Jakobovits et al., *Proc. Natl. Acad. Sci. USA,* 90: 2551 (1993); Jakobovits et al., *Nature,* 362: 255 (1993); Bruggemann et al., *Year in Immunol.,* 7: 33 (1993). While this genetic engineering approach resulted in the expression of human immunoglobulin polypeptides in genetically engineered mice, the level of human immunoglobulin expression is low. This may be due to species-specific regulatory elements in the immunoglobulin loci that are necessary for efficient expression of immunoglobulins. As demonstrated in transfected cell lines, regulatory elements present in human immunoglobulin genes may not function properly in non-human animals.

Indeed, several regulatory elements in immunoglobulin genes have been described. Of particular importance are enhancers downstream (3') of heavy chain constant regions and intronic enhancers in light chain genes. In addition, other, yet to be identified, control elements may be present in immunoglobulin genes. Studies in mice have shown that the membrane and cytoplasmic tail of the membrane form of immunoglobulin molecules play an important role in expression levels of human-mouse chimeric antibodies in the serum of mice homozygous for the human Cγ1 gene. Therefore, for the expression of heterologous immunoglobulin genes in animals it is desirable to replace sequences that contain enhancer elements and exons encoding transmembrane (M1 exon) and cytoplasmic tail (M2 exon) with sequences that are normally found in the animal in similar positions.

In addition to the issues raised by the potential immunogenicity of the non-human antibodies, the use of monoclonal antibodies in general, whether chimeric, humanized or human, is further limited by the fact that devastating diseases, such as cancer and infections with virulent pathogens, are difficult to treat by attacking one target, due to their complexity, multifactorial etiology and adaptivity. Monoclonal antibodies directed against singularly defined targets fail when those targets change, evolve and mutate. Thus, malignancies may gain resistance to standard monoclonal antibody therapies. A solution to this problem is the use of polyclonal antibodies, which have the ability to target and attack a plurality of evolving targets linked with complex diseases. Polyclonal antibodies also have the ability to neutralize bacterial and viral toxins, and direct immune responses to kill and eliminate pathogens.

Accordingly, there is a great clinical need for a new approach suitable for the large-scale production of high-titer, high-affinity, humanized poly- and monoclonal antibodies.

The introduction of human immunoglobulin genes into the genome of mice resulted in expression of a diversified human antibody repertoire in genetically engineered mice. In both mice and humans, primary antibody diversity is generated by gene rearrangement. This process results in the generation of many different recombined V(D)J segments encoding a large number of antibody molecules with different antigen binding sites. However, in other animals, like rabbits, pigs, cows and birds, primary antibody diversity is generated by substantially different mechanisms, namely templated mutations or gene conversion and non-templated mutations or hypermutation. For example, it is well established that in rabbit and chicken, VDJ rearrangement is very limited (almost 90% of immunoglobulin is generated with the 3'proximal VH1 element) and antibody diversity is generated by gene conversion and hypermutation. In contrast, mouse and human gene conversion occurs very rarely, if at all. Therefore, it is expected that in animals that diversify their primary antibody repertoire by gene conversion and hypermutation a genetic engineering approach based on gene rearrangement will result in animals with low antibody titers and limited antibody diversity. Thus, the genetic engineering of large animals for the production of non-immunogenic antibody preparations for human therapy requires alternative genetic engineering strategies.

The production of humanized antibodies in transgenic non-human animals is described in PCT Publication No. WO 02/12437, published on Feb. 14, 2002, the disclosure of which is hereby expressly incorporated by reference in its entirety. WO 02/12437 describes genetically engineered non-human animals containing one or more humanized immunoglobulin loci which are capable of undergoing gene rearrangement and gene conversion in transgenic non-human animals, including animals in which antibody diversity is primarily generated by gene conversion to produce diversified humanized antibodies. The humanized antibodies obtained have minimal immunogenicity to humans and are appropriate for use in the therapeutic treatment of human subjects. It further describes novel nucleotide sequences from the 5' and 3' flanking regions of immunoglobulin heavy chain constant region segments of various non-human mammalians, such as chickens, cows, sheep, and rabbits. Recombinant vectors in which human immunoglobulin heavy chain gene segments are flanked by sequences homologous to such 5' and 3' sequences are shown to be useful for replacing an immunoglobulin heavy chain gene segment of a non-human animal with the corresponding human immunoglobulin heavy chain gene segment.

SUMMARY OF THE INVENTION

In one aspect, the present invention concerns an isolated nucleic acid molecule comprising a human immunoglobulin gene segment, flanked by nucleotide sequences, wherein the flanking sequences are identical or different, and comprise at least about 20 contiguous nucleotides of a spacer sequence from an immunoglobulin heavy or light chain gene of an animal generating antibody diversity primarily by gene conversion and/or hypermutation, or from a consensus sequence of two or more of the spacer sequences.

In another aspect, the invention concerns an isolated nucleic acid molecule comprising a human immunoglobulin heavy or light chain constant region (C) gene segment, flanked by nucleotide sequences, wherein the flanking sequences are identical or different, and comprise at least about 20 contiguous nucleotides of a spacer sequence from an immunoglobulin heavy or light chain gene of a non-primate animal, or from a consensus sequence of two or more of the spacer sequences.

In a further aspect, the invention concerns an isolated nucleic acid molecule comprising a human immunoglobulin heavy or light chain gene segment, flanked by nucleotide sequences, wherein the flanking sequences are identical or different, and comprise at least about 20 contiguous nucleotides of a spacer sequence selected from the group consisting of SEQ ID NOS: 1 to 185 (Table 1), or from a consensus sequence of two or more of the spacer sequences.

In one embodiment, the flanking sequences comprise at least about 50 contiguous nucleotides of a spacer sequence.

In another embodiment, the human immunoglobulin gene segment is a heavy chain V, D, or J segment, where the V fragment may, for example be a member of the VH3, VH1, VH5, or VH4 family.

In a further embodiment, the human immunoglobulin gene segment is a light chain V or J segment, where the V segment may, for example be a κ light chain gene segment, such as Vκ1, Vκ3, or Vκ4, or a λ light chain segment, e.g. Vλ1, Vλ2 or Vλ3.

In a further embodiment, the non-primate animal which generates antibody diversity primarily by gene conversion and/or somatic hypermutation is, for example, rabbit, pig, bird, e.g. chicken, turkey, duck, or goose, sheep, goat, cow, horse or donkey, however, other non-primate animals, e.g. rodents are also specifically included within the scope of the invention.

In another aspect, the invention concerns a recombination vector comprising any of the foregoing nucleic acid molecules.

In yet another aspect, the invention concerns a transgenic vector comprising a humanized immunoglobulin (Ig) locus, wherein the humanized Ig locus is derived from an Ig locus or a portion of an Ig locus of a non-human animal, comprising multiple Ig segments wherein (a) at least one of the gene segments is a human Ig gene segment flanked by nucleotide sequences comprising at least about 20 contiguous nucleotides from a spacer sequence, or from a consensus sequence or two or more of such spacer sequences;

(b) the gene segments are juxtaposed in an unrearranged, partially rearranged or fully rearranged configuration, and (c) the humanized Ig locus is capable of undergoing gene rearrangement, if necessary, as well as gene conversion and/or hypermutation, if the non-human animal is a gene converting animal, and producing a repertoire of humanized immunoglobulins in the non-human animal.

In a further embodiment, the humanized Ig heavy chain locus present in the transgenic vector comprises about 5 to 100 V gene segments, with at least one human V gene segment. In a specific embodiment, the humanized Ig heavy chain locus comprises more than one human V gene segments.

In another embodiment, the humanized Ig heavy chain locus present in the transgenic vector comprises about 5 to 25 D gene segments, In a specific embodiment, the humanized Ig heavy chain locus comprises one or several human D gene segments.

In yet another embodiment, the humanized Ig heavy chain locus present in the transgenic vector comprises about 1 to 10 J gene segments, with at least one human J gene segment. In a specific embodiment, the humanized Ig heavy chain locus comprises more than one human J gene segments.

In another embodiment, the humanized Ig heavy chain locus present in the transgenic vector comprises about 1-25 C region segments, with at least one human C region segment. In a specific embodiment, the humanized Ig heavy chain locus present in the transgenic vector comprises more than one human C gene segment.

In a still further embodiment, the humanized Ig locus present in the transgenic vector is a light chain locus of a non-human animal, and it comprises at least one V gene segment, at least one J gene segment and at least one constant (C) region gene segment, where at least one gene segment is selected from the group of human light chain V and J segments and human light chain C region segments. In a specific embodiment, the constant region gene segment is a human light chain constant region gene segment, which can, for example, be a Cλ or Cκ gene segment. In another embodiment, the humanized Ig light chain locus comprises two or more segments selected from human V and J segments and human C region segments. In a further embodiment, the humanized Ig light chain locus comprises at least one human V segment, at least one human J segment, and at least one human C region segment.

In a further embodiment, the humanized Ig light chain locus present in the transgenic vector comprises about 5-100 V gene segments, with at least one human V gene segment, wherein the human V gene segment is placed downstream to the 5-100 V gene segments of the non-human animal. In a specific embodiment, the human V gene segment is placed immediately 5' to a J gene segment in a rearranged configuration. In another embodiment, the humanized Ig light chain locus present in the transgenic vector comprises more than one human V gene segment.

In a still further embodiment, the humanized Ig light chain locus present in the transgenic vector comprises about 1-10 J gene segments, with at least one human J gene segment. In a specific embodiment, the humanized Ig light chain locus present in the transgenic vector comprises more than one human J gene segment.

In another embodiment, the humanized Ig light chain locus present in the transgenic vector comprises about 1-25 C region segments, with at least one human C region segment. In a specific embodiment, the humanized Ig light chain locus present in the transgenic vector comprises more than one human C gene segment.

In a still further embodiment, the humanized Ig locus present in the transgenic vector is a light chain locus of a non-human animal, and it comprises at least one V gene segment, at least one J gene segment and at least one constant (C) region gene segment, where at least one gene segment is selected from the group of human light chain V and J segments and human light chain C region segments. In a specific embodiment, the constant region gene segment is a human light chain constant region gene segment, which can, for example, be a Cλ or Cκ gene segment. In another embodiment, the humanized Ig light chain locus comprises two or more segments selected from human V and J segments and human C region segments. In a further embodiment, the humanized Ig light chain locus comprises at least one human V segment, at least one human J segment, and at least one human C region segment.

In a different aspect, the invention concerns a nucleic acid molecule comprising two or more units consisting of, from 5' to 3' direction, a 5' nucleotide sequence, a human immunoglobulin sequence, and a 3' nucleotide sequence, wherein the 5' and 3' nucleotide sequences are identical or different, and comprise at least about 20 contiguous nucleotides from a spacer sequence separating the coding regions in a non-primate animal immunoglobulin heavy or light chain gene, or from a consensus sequence of two or more of the spacer sequences. In a specific embodiment, the spacer sequences are selected from within SEQ ID NOS: 1 to 185 (Table 1). In another particular embodiment, the 5' and/or 3' nucleotide sequences in all repetitive units of the nucleic acid molecule are identical. In another particular embodiment, the repetitive units of the nucleic acid molecule comprise at least two different 5' and/or 3' sequences. In a further embodiment, the 5' and 3' nucleotide sequence are different from each other, but all 5' and all 3' nucleotide sequences are identical.

In a further aspect, the invention concerns a method for making a transgenic vector comprising a humanized immunoglobulin (Ig) locus capable of producing a functional repertoire of humanized antibodies in a non-human animal, comprising:

(a) obtaining a DNA fragment comprising an Ig locus or a portion thereof from the non-human animal which comprises at least one V gene segment, at least one J gene segment and at least one constant region gene segment; and (b) integrating at least one human Ig gene segment into the DNA fragment of step (a) to produce a humanized Ig locus, wherein the human Ig gene segment flanked by nucleotide sequences comprising at least about 20 contiguous nucleotides from a spacer sequence separating the coding regions in a non-primate animal immunoglobulin heavy or light chain gene, or from a consensus sequence or two or more of such spacer sequences; wherein (i) the gene segments are juxtaposed in an unrearranged, partially rearranged or fully rearranged configuration, and (ii) the humanized Ig locus is capable of undergoing gene rearrangement, if necessary, and producing a repertoire of humanized immunoglobulins in the non-human animal.

The humanized Ig locus can be a humanized Ig heavy chain or light chain locus. In the case of a humanized Ig heavy chain locus the DNA fragment obtained in step (a) additionally comprises at least one D gene segment.

In another aspect, the invention concerns a transgenic animal comprising a humanized immunoglobulin locus described above, and methods for making such transgenic animals. In one embodiment, the transgenic animal comprises both a humanized immunoglobulin heavy chain locus and a humanized immunoglobulin light chain locus. In another embodiment, only one of the heavy and light chain loci present in the transgenic animal is humanized. In another embodiment, all of the V, D, J and C regions of at least one of the animal's immunoglobulin loci are humanized. In yet another embodiment, all of the V, D, J, and C region of the transgenic animals endogenous immunoglobulin loci are humanized.

In a further aspect, the invention concerns a B cell from the transgenic animals produced in accordance with the present invention.

In a still further aspect, the invention concerns a humanized immunoglobulin produced using a transgenic animal of the present invention, and an antibody preparation or a pharmaceutical composition comprising the humanized immunoglobulin.

BRIEF DESCRIPTION OF THE DRAWINGS

FIGS. 12a to 12c show a humanized light chain locus. A synthetic sequence (FIG. 12a, Unit 1, 12,235 bp, SEQ ID NO: 187) containing 17 human V pseudogenes and 18 chicken spacer sequences is shown in (a). A second synthetic sequence (FIG. 12b, Unit 2, 13,283 bp, SEQ ID NO: 188) containing a functional rearranged human VkJk gene fragment, 11 human V pseudogenes, 12 chicken spacer sequnes and 2 introns is shown in (b). Units 1 and 2 were combined with a fragment derived from BAC 179L1 containing human Ck and rabbit intron and spacer sequences (FIG. 12c).

FIG. 13a-e show a humanized heavy chain locus. Four synthetic DNA fragments (Unit1-4, FIG. 13a-d, SEQ ID NOS: 189, 190, 191, 192) consisting of human VH3 gene fragments and rabbit spacer and intron sequences were combined with parts of BAC 219D23, 27N5 and Fos15B as shown in (FIG. 13e).

DETAILED DESCRIPTION OF THE INVENTION

A. Definitions

Figure 1:
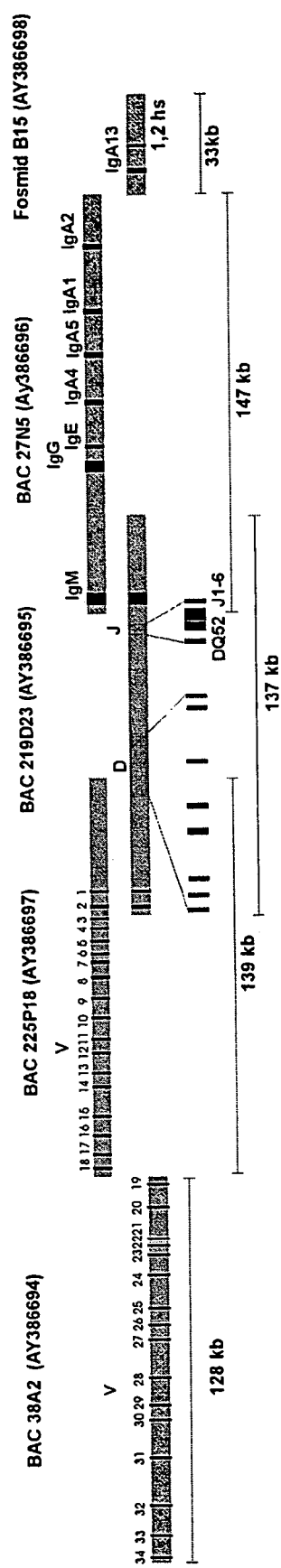
FIG. 1 is a schematic depiction of the rabbit immunoglobulin gene heavy chain locus.

"Antibodies" (Abs) and "immunoglobulins" (Igs) are glycoproteins having the same structural characteristics. While antibodies exhibit binding specificity to a specific antigen, immunoglobulins include both antibodies and other antibody-like molecules which lack antigen specificity. Polypeptides of the latter kind are, for example, produced at low levels by the lymph system and at increased levels by myelomas.

"Native antibodies and immunoglobulins" are usually heterotetrameric glycoproteins of about 150,000 daltons, composed of two identical light (L) chains and two identical heavy (H) chains. Each light chain is linked to a heavy chain by covalent disulfide bond(s), while the number of disulfide linkages varies between the heavy chains of different immunoglobulin isotypes. Each heavy and light chain also has regularly spaced intrachain disulfide bridges. Each heavy chain has at one end a variable domain (VH) followed by a number of constant domains. Each light chain has a variable domain at one end (VL) and a constant domain at its other end; the constant domain of the light chain is aligned with the first constant domain of the heavy chain, and the light chain variable domain is aligned with the variable domain of the heavy chain. Particular amino acid residues are believed to form an interface between the light- and heavy-chain variable domains (Clothia et al., *J. Mol. Biol.* 186:651 (1985); Novotny and Haber, *Proc. Natl. Acad. Sci. U.S.A.* 82:4592 (1985)).

The term "variable" refers to the fact that certain portions of the variable domains differ extensively in sequence among antibodies and are used in the binding and specificity of each particular antibody for its particular antigen. However, the variability is not evenly distributed throughout the variable domains of antibodies. It is concentrated in three segments called complementarity-determining regions (CDRs) or hypervariable regions both in the light-chain and the heavy-chain variable domains. The more highly conserved portions of variable domains are called the framework (FR). The variable domains of native heavy and light chains each comprise four FR regions, connected by three CDRs. The CDRs in each chain are held together in close proximity by the FR regions and, with the CDRs from the other chain, contribute to the formation of the antigen-binding site of antibodies (see Kabat et al., *Sequences of Proteins of Immunological Interest*, Fifth Edition, National Institute of Health, Bethesda, Md. (1991)). The constant domains are not involved directly in binding an antibody to an antigen, but exhibit various effector functions, such as participation of the antibody in antibody-dependent cellular toxicity.

The term "monoclonal antibody" is used to refer to an antibody molecule synthesized by a single clone of B cells.

The term "polyclonal antibody" is used to refer to a population of antibody molecules synthesized by many clones of B cells. In a specific embodiment, polyclonal antibodies recognize several epitopes.

The terms "a humanized antibody" and "a humanized immunoglobulin", as used herein, mean an immunoglobulin molecule comprising at least a portion of a human immunoglobulin polypeptide sequence (or a polypeptide sequence encoded by a human immunoglobulin gene segment). The humanized immunoglobulin molecules of the present invention can be isolated from a transgenic non-human animal engineered to produce humanized immunoglobulin molecules. Such humanized immunoglobulin molecules are less immunogenic to primates, especially humans, relative to non-humanized immunoglobulin molecules prepared from the animal or prepared from cells derived from the animal.

The term "non-human animal" as used herein includes, but is not limited to mammals, and includes, for example, non-human primates, rabbits, pigs, birds (e.g., chickens, turkeys, ducks, geese and the like), sheep, goats, cows, horses, and rodents (e.g. mice and rats). Preferred non-human animals are those animals which create antibody diversity substantially by gene conversion and/or somatic hypermutation, e.g., rabbit, pigs, birds (e.g., chicken, turkey, duck, goose and the like), sheep, goat, and cow. Particularly preferred non-human animals are rabbit and chicken.

The term "non-primate animal" as used herein includes, but is not limited to, mammals other than primates, including those listed above.

The phrase "animals which create antibody diversity substantially by gene conversion and/or hypermutation" is used to refer to animals in which the predominant mechanism of antibody diversification is gene conversion and/or hypermutation as opposed to gene rearrangement.

The term "Ig gene segment" as used herein refers to segments of DNA encoding various portions of an Ig molecule, which are present in the germline of animals and humans, and which are brought together in B cells to form rearranged Ig genes. Thus, Ig gene segments as used herein include V gene segments, D gene segments, J gene segments and C region gene segments.

The term "human Ig gene segment" as used herein includes both naturally occurring sequences of a human Ig gene segment, degenerate forms of naturally occurring sequences of a human Ig gene segment, as well as synthetic sequences that encode a polypeptide sequence substantially identical to the polypeptide encoded by a naturally occurring sequence of a human Ig gene segment. By "substantially" is meant that the degree of amino acid sequence identity is at least about 85%-95%. In a particular embodiment, the human Ig gene segment renders the immunoglobulin molecule non-immunogenic in humans.

A specific humanized immunoglobulin molecule of the present invention contains at least a portion of a human heavy or light chain variable region polypeptide sequence. Another specific immunoglobulin molecule contains at least a portion of a human heavy or light chain variable region polypeptide sequence, and at least a portion of a human constant domain polypeptide sequence.

By "a preparation of humanized antibodies" or "a humanized antibody preparation" is meant an isolated antibody product or a purified antibody product prepared from a transgenic non-human animal (e.g., serum, milk, or egg yolk of the animal) or from cells derived from a transgenic non-human animal (e.g., a B-cell or a hybridoma cell).

A humanized antibody preparation can be a preparation of polyclonal antibodies, which includes a repertoire of humanized immunoglobulin molecules. A humanized antibody preparation can also be a preparation of a monoclonal antibody.

The terms "antibody diversity" and "antibody repertoire" are used interchangeably, and refer to the total of all antibody specificities that an organism is capable of expressing.

The term "spacer sequence" is used herein to refer to any non-coding nucleotide sequence present in an immunoglobulin heavy or light chain gene. Thus, the term specifically includes intron sequences and any other non-coding sequences separating the coding regions within the V, D, J segments and C region segments in an immunoglobulin heavy chain gene, intron sequences and any other non-coding sequences separating the coding regions within the V and J segments an C region segments in an immunoglobulin light chain gene, as well as non-coding sequence flanking regulatory elements, such as enhancers, in an immunoglobulin heavy or light chain gene. In addition, non-coding sequences between exons encoding parts of a membrane-spanning helix and heavy and light chain enhancers are specifically included.

An Ig locus having the capacity to undergo gene rearrangement and gene conversion is also referred to herein as a "functional" Ig locus, and the antibodies with a diversity generated by a functional Ig locus are also referred to herein as "functional" antibodies or a "functional" repertoire of antibodies.

B. Relevant Literature

Regulatory elements in immunoglobulin genes have been described by Bradley et al. (1999), *Transcriptional enhancers and the evolution of the IgH locus*; Lauster, R. et al., *Embo J* 12: 4615-23 (1993); Volgina et al., *J Immunol* 165:6400 (2000); Hole et al., *J Immunol* 146:4377 (1991).

Antibody diversification by gene conversion in chicken and rabbit has been described by Bucchini et al., *Nature* 326: 409-11 (1987); Knight et al., *Advances in Immunology* 56: 179-218 (1994); Langman et al., *Res Immunol* 144: 422-46 (1993). The generation of mice expressing human-mouse chimeric antibodies has been described by Pluschke et al., *Journal of Immunological Methods* 215: 27-37 (1998). The generation of mice expressing human-mouse chimeric antibodies with mouse derived membrane and cytoplamic tails has been described by Zou et al., *Science* 262: 1271-1274 (1993); Zou et al. *Curr Biol* 4: 1099-1103. The generation of mice expressing human immunoglobulin polypeptides has been described by Bruggemann et al. *Curr Opin Biotechnol* 8(4): 455-8 (1997); Lonberg et al. *Int Rev Immunol* 13(1):65-93 (1995); Neuberger et al., *Nature* 338: 350-2 (1989). Generation of transgenic mice using a BAC clone has been described by Yang et al., *Nat Biotechnol* 15: 859-65 (1997). The generation of cows expressing human antibodies has been described by Kuroiwa et al., Nature Biotech 20(9): 889-894 (2002).

The generation of transgenic rabbits has been described by Fan, J. et al., Pathol Int 49: 583-94 (1999); Brem et al., *Mol Reprod Dev* 44: 56-62 (1996). Rabbits with impaired immunoglobulin expression have been described by McCartney-Francis et al., *Mol Immunol* 24: 357-64 (1987); Allegrucci, et al., *Eur J Immunol* 21: 411-7 (1991).

The production of transgenic chicken has been described by Sherman et al., Nature Biotech 16:1050-1053 (1998); Etches et al., *Methods in Molecular Biology* 62: 433-450; Pain et al., *Cells Tissues Organs* 165(3-4): 212-9 (1999); Sang, H., "Transgenic chickens—methods and potential applications", *Trends Biotechnol* 12:415 (1994); and in WO2004003157, "Gene regulation in transgenic animals using a transposon based vector"; and in WO 200075300, "Introducing a nucleic acid into an avian genome, useful for transfecting avian blastodermal cells for producing transgenic avian animals with the desired genes, by directly introducing the nucleic acid into the germinal disc of the egg".

A gammaglobulinemic chicken have been described by Frommel et al., *J Immunol* 105(1): 1-6 (1970); Benedict et al., *Adv Exp Med Biol* 1977; 88(2): 197-205.

The cloning of animals from cells has been described by T. Wakayama et al., Nature 1998; 394:369-374; J. B. Cibelli et al., Science 280:1256-1258 (1998); J. B. Cibelli et al., *Nature Biotechnology* 1998; 16:642-646; A. E. Schnieke et al., Science 278: 2130-2133 (1997); K. H. Campbell et al., Nature 380: 64-66 (1996), Kuroiwa et al., Nature Genetics 2004, June 6. Nuclear transfer cloning of rabbits has been described by Stice et al., *Biology of Reproduction* 39: 657-664 (1988), and Challah-Jacques et al., Cloning and Stem Cells 8(4):295-299 (2003).

Production of antibodies from transgenic animals is described in U.S. Pat. No. 5,814,318, No. 5,545,807 and No. 5,570,429. Homologous recombination for chimeric mammalian hosts is exemplified in U.S. Pat. No. 5,416,260. A method for introducing DNA into an embryo is described in U.S. Pat. No. 5,567,607. Maintenance and expansion of embryonic stem cells is described in U.S. Pat. No. 5,453,357.

The mechanisms involved in the diversification of the antibody repertoire in pigs, sheep and cows are reviewed in Butler, J. E. (1998), "Immunoglobulin diversity, B-cell and antibody repertoire development in large farm animals", *Rev Sci Tech* 17:43. Antibody diversification in sheep is described in Reynaud, C. A., C. Garcia, W. R. Hein, and J. C. Weill (1995), "Hypermutation generating the sheep immunoglobulin repertoire is an antigen-independent process", *Cell* 80:115; and Dufour, V., S. Malinge, and F. Nau. (1996), "The sheep Ig variable region repertoire consists of a single VH family," *J Immunol* 156:2163.

C. Detailed Description

Immunoglobulin heavy and light chain genes comprise several segments encoded by individual genes and separated by intron sequences. Thus genes for the human immunoglobulin heavy chain are found on chromosome 14. The variable region of the heavy chain (VH) comprises three gene segments: V, D and J segments, followed by multiple genes coding for the C region. The V region is separated from the C region by a large spacer, and the individual genes encoding the V, D and J segments are also separated by spacers.

There are two types of immunoglobulin light chains: κ and λ. Genes for the human κ light chain are found on chromosome 2 and genes for the human λ light chain are found on chromosome 22. The variable region of antibody light chains includes a V segment and a J segment, encoded by separate gene segments. In the germline configuration of the κ light chain gene, there are approximately 100-200 V region genes in linear arrangement, each gene having its own leader sequence, followed by approximately 5 J gene segments, and C region gene segment. All V regions are separated by introns, and there are introns separating the V, J and C region gene segments as well.

The immune system's capacity to protect against infection rests in a genetic machinery specialized to create a diverse repertoire of antibodies. Antibody-coding genes in B cells are assembled in a manner that allows to countless combinations of binding sites in the variable (V) region. It is estimated that more than $10^{12}$ possible binding structures arise from such mechanisms. In all animals, including humans, the antibody-making process begins by recombining variable (V), diversity (D) and joining (J) segments of the immunoglobulin (Ig) locus. Following this step, depending on the animal species, two general mechanisms are used to produce the diverse binding structures of antibodies.

In some animals, such as human and mouse, there are multiple copies of V, D and J gene segments on the immunoglobulin heavy chain locus, and multiple copies of V and J gene segments on the immunoglobulin light chain locus. Antibody diversity in these animals is generated primarily by gene rearrangement, i.e., different combinations of gene segments to form rearranged heavy chain variable region and light chain variable region. In other animals (e.g., rabbit, birds, e.g., chicken, goose, and duck, sheep, goat, and cow), however, gene rearrangement plays a smaller role in the generation of antibody diversity. For example, in rabbit, only a very limited number of the V gene segments, most often the V gene segments at the 3' end of the V-region, is used in gene rearrangement to form a contiguous VDJ segment. In chicken, only one V gene segment (the one adjacent to the D region, or "the 3' proximal V gene segment"), one D segment and one J segment are used in the heavy chain rearrangement; and only one V gene segment (the 3' proximal V segment) and one J segment are used in the light chain rearrangement. Thus, in these animals, there is little diversity among initially rearranged variable region sequences resulting from junctional diversification. Further diversification of the rearranged Ig genes is achieved by gene conversion, a process in which short sequences derived from the upstream V gene segments replace short sequences within the V gene segment in the rearranged Ig gene. Additional diversification of antibody sequences may be generated by hypermutation.

Immunoglobulins (antibodies) belong into five classes (IgG, IgM, IgA, IgE, and IgD, each with different biological roles in immune defense. The most abundant in the blood and potent in response to infection is the IgG class. Within the human IgG class, there are four sub-classes (IgG1, IgG2, IgG3 and IgG4 isotypes) determined by the structure of the heavy chain constant regions that comprise the Fc domain. The F(ab) domains of antibodies bind to specific sequences (epitopes) on antigens, while the Fc domain of antibodies recruits and activates other components of the immune system in order to eliminate the antigens.

Antibodies have been used successfully as therapeutics since the 1890s when it was found that polyclonal antiserum taken from animals could treat life-threatening infections in humans. A significant advance in antibody research occurred with the development of methods for the recombinant production of antibodies, followed by the development of antibody humanization techniques and method for making fully human monoclonal antibodies in non-human animals.

As a result, chimeric, humanized and human monoclonal antibodies have recently emerged as an important class of pharmaceutical products. While monoclonal antibody-based drugs are very effective in treating diseases when blocking a particular target (e.g. receptor or ligand) certain devastating diseases, such as cancer and infections with virulent pathogens, may be difficult to treat due to their complexity, multi-factoral etiology and adaptivity. Monoclonal antibodies address singularly defined targets that change, evolve and mutate during the spread of diseases throughout a population or within an individual. Such adaptive evolution is the bane of mono-specific drugs (e.g. monoclonal antibodies), which are quickly circumvented by resistant strains. Examples abound of bacterial and viral resistance to high-potency antibiotics, and malignant cancers that develop resistance to standard anticancer drugs, such as monoclonal antibody therapies.

In contrast, polyclonal antibodies have the ability to bind and eliminate a plurality of evolving targets linked with complex diseases. By binding multiple antigens, polyclonal antibodies saturate the target and retain activity even in the event of antigen mutation. Following this, through a cascade of signals, polyclonal antibodies induce a potent immune response to eliminate the target antigen, pathogen or cell. These properties make polyclonal antibodies ideal for treating infectious diseases and cancer.

So far, the use of polyclonal antibodies has been severely limited by either supply problems or unwanted reactions to non-human proteins.

The present invention provides a new humanization approach, based on selective humanization the immunoglobulin-coding elements of the immunoglobulin (Ig) translocus. The creation of such human-animal translocus allows for the creation of transgenic animals that express diversified, high-affinity humanized (polyclonal) antibodies in high yields.

Figure 5:
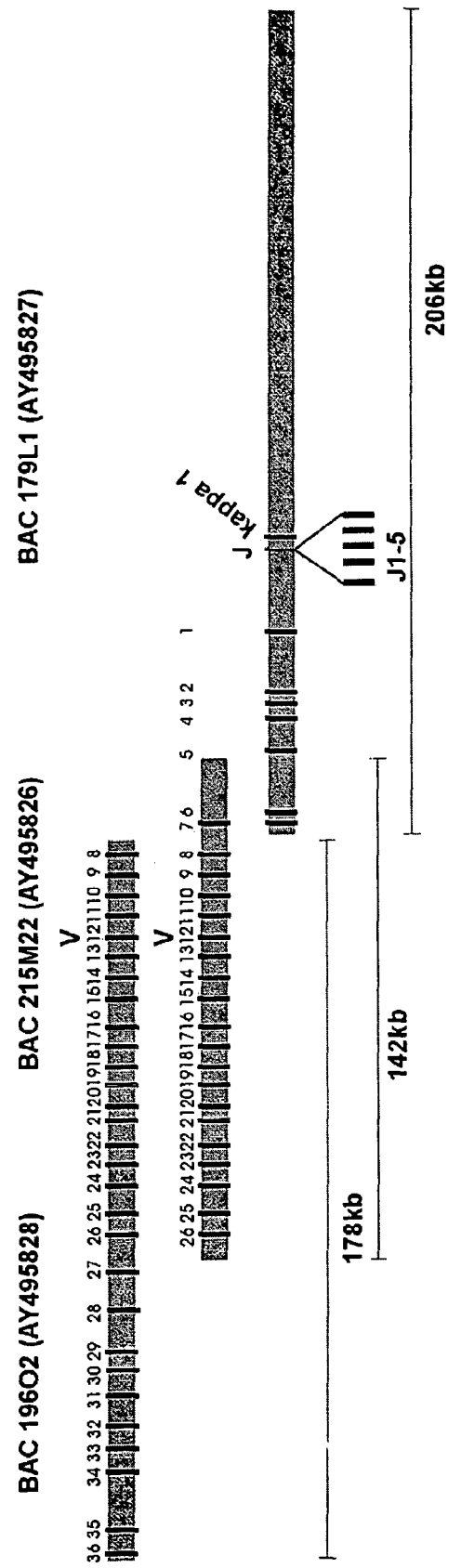
FIG. 5 is a schematic depiction of the rabbit immunoglobulin light chain locus.
Figure 9A:
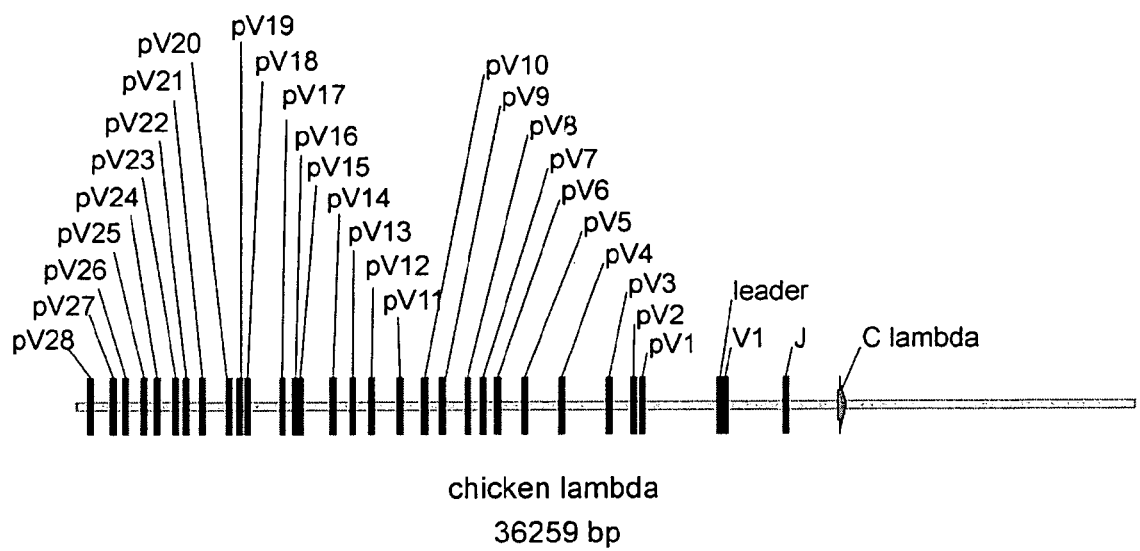
FIG. 9a shows the sequence of a BAC clone comprising a chicken light chain genomic locus whose nucleotide sequence is shown in FIG. 9b (SEQ ID NO: 186).

As a first step, the genomic loci for non-human, including non-primate, immunoglobulin heavy and light chains are identified and sequenced. For example, as part of the present invention, genomic sequences for rabbit and chicken immunoglobulin heavy and light chains were determined, and are shown in FIGS. 1, 5, and 9.

Analysis of the rabbit Ig heavy chain genomic locus has shown that the immunoglobulin heavy chain variable region (Vh) contains numerous genes, including functional genes and non-functional pseudogenes. Alignment of 18 Vh genes has revealed a high degree (80-90%) sequence identity among rabbit heavy chain variable region gene sequences (Vh1-Vh18). The rabbit heavy chain variable region genes have been found to share highest homology with the Vh3 group of the human heavy chain variable region genes. Specifically, sequence comparison of the rabbit Vh1-a2 gene with the human Vh3-23 sequences has revealed 72.8% sequence identity.

Figure 2:
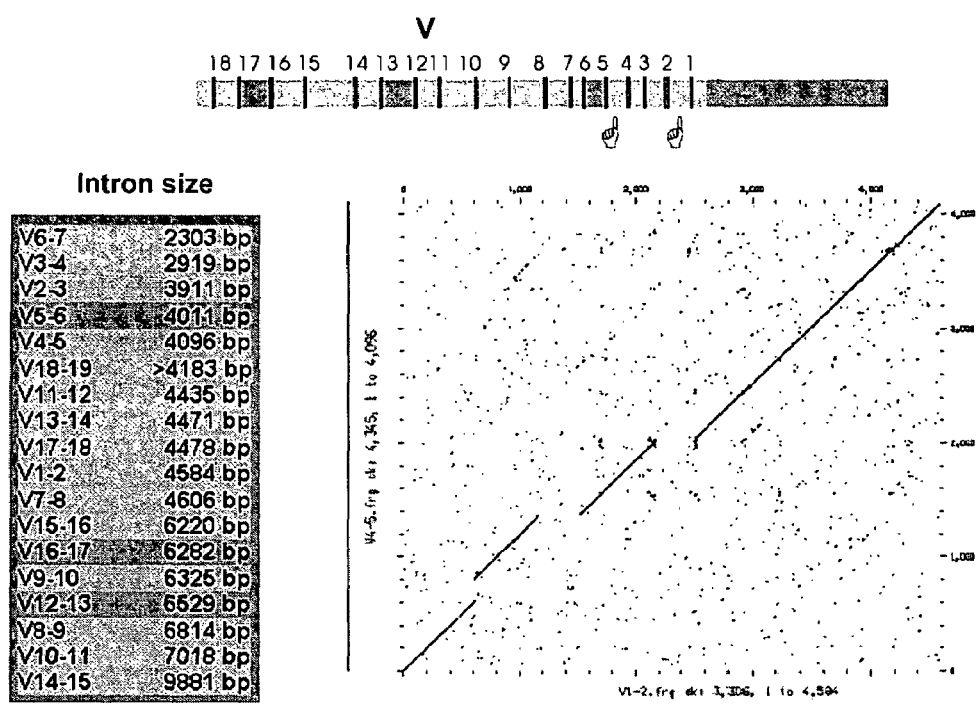
FIGS. 2-4 show a comparison of rabbit heavy chain spacer sequences.
Figure 3:
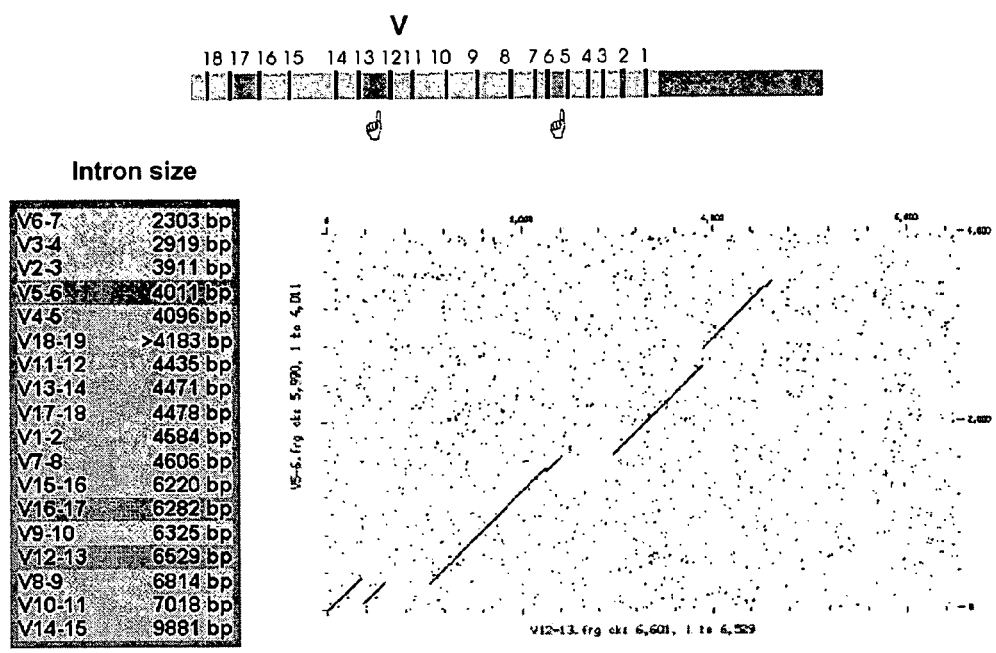
Figure 4:
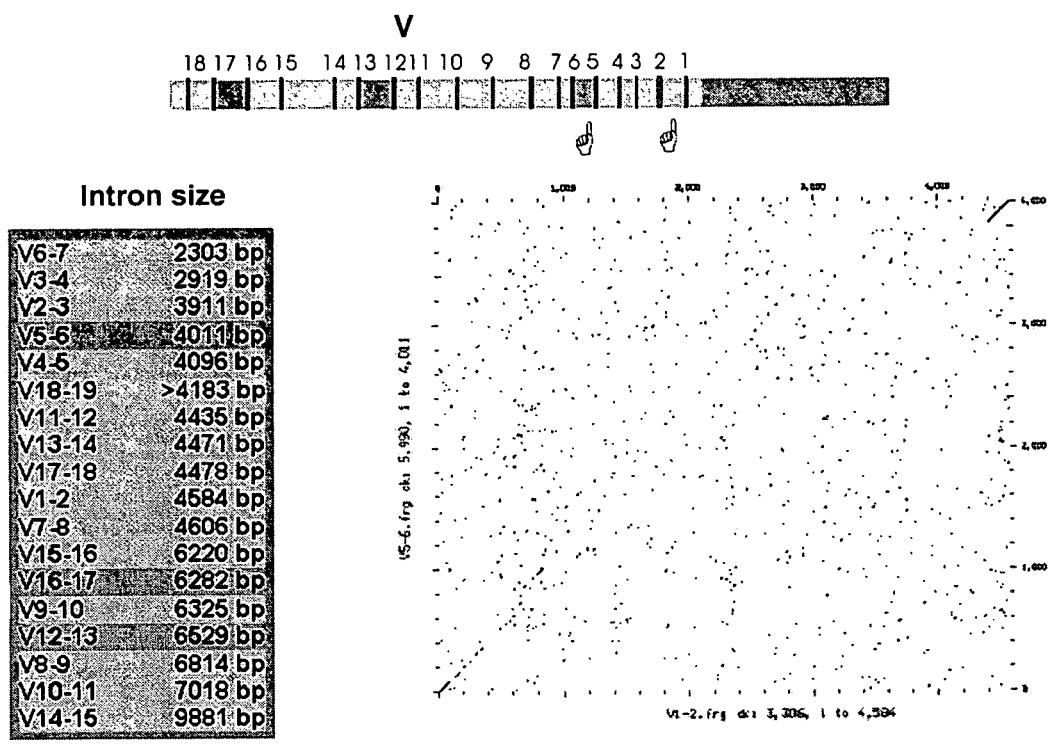

In addition, the non-coding (e.g. intron) sequences separating the rabbit heavy chain variable region gene sequences were analyzed. FIGS. 2-4 show a comparison of rabbit heavy chain intron sequences. It has been found that such intron sequences fall into two groups, and are highly conserved. Especially members of the Group 1 introns show a surprisingly high (80-90%) sequence identity.

Similar findings were made by analysis of rabbit immunoglobulin light chain variable region genomic sequences. In particular, analysis of the rabbit immunoglobulin light chain locus has shown that the light chain variable region (Vl) region contains numerous gene segments, which show a high degree (80-90% sequence identity). It has further been found that the rabbit light chain variable region (Vκ) exhibits high homology with the Vκ1 group of the human light chain variable region gene sequences. Most Vκ sequences have been found to be functional and highly conserved. Unlike in the rabbit heavy chain variable region genes, in the rabbit light chain variable region genes the intron sequences have been found to be heterogeneous.

Similar studies with chicken immunoglobulin heavy and light chain genomic sequences provide analogous results.

In one aspect, the present invention provides spacer sequences, which separate the coding regions in a non-primate animal heavy or light chain gene. In one embodiment, the present invention provides spacer sequences from the heavy and light chain genes of animals which create antibody diversity substantially by gene conversion, including, for example, rabbit and chicken. Such spacer sequences are then used to flank human immunoglobulin heavy or light chain gene segments used in the process of creating a humanized immunoglobulin locus.

The spacer sequences typically comprise at least about 20 nucleotides, or at least about 30 nucleotides, or at least about 40 nucleotides, or at least about 50 nucleotides, and typically are between about 20 and about 10000 nucleotides in length. The spacer sequences may contain a contiguous stretch of nucleotides of appropriate length from a naturally occurring intron sequence in a non-human (e.g. non-primate) animal, or may include an artificial sequence, which may, for example, be a consensus sequence of two or more naturally occurring intron sequences.

The spacer sequences may comprise at least about 20 (30, 40, 50, etc. up to 1000 in 10-nucleotide increments) contiguous nucleotides from a sequence selected from the group consisting of SEQ ID NOS 1 to 185 (Table 1), or from a consensus sequence of two or more of such sequences. It is possible, but not necessary, to separate human heavy or light chain sequences (e.g. V, D, J, C region sequences) used for humanization by spacer sequences that separate the corresponding regions within the genomic sequence of the non-human (non-primate) animal the immunoglobulin of which is humanized.

In general, the humanization of an immunoglobulin (Ig) locus in a non-human animal involves the integration of one or more human Ig gene segments into the animal's genome to create humanized immunoglobulin loci. Thus, creation of a humanized Ig heavy chain locus involves the integration of one or more V and/or D and/or J segments, and/or C region segments into the animal's genome. Similarly, the creation of a humanized Ig light chain locus involves the integration of one or more V and/or J segments, and/or C region segments into the animal's genome.

Depending upon the approach used, the human Ig gene segment(s) can be integrated at the chromosomal location where the endogenous Ig locus of the animal ordinarily resides, or at a different locus of the animal. Regardless of the chromosomal location, the humanized Ig locus of the present invention has the capacity to undergo gene rearrangement and gene conversion and hypermutation in the non-human animal, thereby producing a diversified repertoire of humanized Ig molecules. An Ig locus having the capacity to undergo gene rearrangement and gene conversion is also referred to as a "functional" Ig locus and the antibodies with a diversity generated by a functional Ig locus are also referred to as "functional" antibodies or a "functional" repertoire of antibody molecules.

In a further aspect, the invention provides nucleic acid molecules comprising a human Ig gene segment, flanked by nucleotide sequences which comprise at least bout 20 contiguous nucleotides from a spacer sequence separating the coding regions in a non-primate animal Ig heavy or light chain gene, or from a consensus sequence of two or more of such spacer sequences. The flanking sequences just as the spacer sequence-derived sections within the flanking sequences can be identical or different. The contiguous nucleotides derived from a spacer sequence or from a consensus sequence of two or more spacer sequences can be fused directly to the human Ig gene segment. Alternatively, there might be an intervening sequence between the human Ig gene segment and at least one of the spacer-originating nucleotide sequences. Thus, for example, a flanking sequence at the 5' end of a human V gene segment may include a promoter region, which is linked directly to the human V gene segment, and separates it from the spacer-sequence derived nucleotide stretch of at least 20 nucleotides.

In yet another aspect, the invention concerns a humanized Ig heavy chain locus in which human heavy chain V, D and/or J gene segments and/or C region segments are present in the same configuration as in the original non-human animal immunoglobulin gene, and separated by sequences including at least about 20 contiguous nucleotides from an intron sequence separating the coding regions in a non-primate animal Ig heavy or light chain gene. In another embodiment, the present invention provides a humanized light chain locus in which human light chain C region segments and/or J gene segments and/or V region segments are separated by non-human animal (e.g. non-primate) intron sequences in the same configuration as in the original non-human animal immunoglobulin gene. In a particular embodiment, the spacer sequences are designed based on non-coding, e.g. intron sequences of the non-human (non-primate) animal. In one embodiment, the spacers may retain the appropriate non-coding sequences from the non-human (non-primate) animal. Alternatively, in order to simplify the construct, a consensus sequence, designed based upon the highly homologous non-coding (intron) sequences may be designed, and used as a uniform spacer sequence for the preparation of multiple human heavy or light chain gene segments.

The invention specifically provides isolated nucleic acid sequences and vectors useful in the construction of humanized immunoglobulin loci.

In one embodiment, DNA fragments containing an Ig locus to be humanized are isolated from animals which generate antibody diversity by gene conversion, e.g., rabbit and chicken. Such large DNA fragments can be isolated by screening a library of plasmids, cosmids, yeast artificial chromosomes (YACs) or bacterial artificial chromosomes (BACs), and the like, prepared from the genomic DNA of the non-human, e.g. non-primate animal. An entire animal C-region can be contained in one plasmid or cosmid clone which is subsequently subjected to humanization. YAC clones can carry DNA fragments of up to 2 megabases, thus an entire animal heavy chain locus or a large portion thereof can be isolated in one YAC clone, or reconstructed to be contained in one YAC clone. BAC clones are capable of carrying DNA fragments of smaller sizes (about 150-450 kb). However, multiple BAC clones containing overlapping fragments of an Ig locus can be separately humanized and subsequently injected together into an animal recipient cell, wherein the overlapping fragments recombine in the recipient animal cell to generate a continuous Ig locus.

Human Ig gene segments can be integrated into the Ig locus on a vector (e.g., a BAC clone) by a variety of methods, including ligation of DNA fragments, or insertion of DNA fragments by homologous recombination. Integration of the human Ig gene segments is done in such a way that the human Ig gene segment is operably linked to the host animal sequence in the transgene to produce a functional humanized Ig locus, i.e., an Ig locus capable of gene rearrangement and gene conversion and hypermutation which lead to the production of a diversified repertoire of humanized antibodies.

In one embodiment, human Ig gene segments can be integrated into the Ig locus by homologous recombination. Homologous recombination can be performed in bacteria, yeast and other cells with a high frequency of homologous recombination events. For example, a yeast cell is transformed with a YAC containing an animal's Ig locus or a large portion thereof. Subsequently, such yeast cell is further transformed with a recombination vector as described hereinabove, which carries a human Ig gene segment linked to a 5' flanking sequence and a 3' flanking sequence. The 5' and the 3' flanking sequences in the recombination vector are homologous to those flanking sequences of the animal Ig gene segment on the YAC. As a result of a homologous recombination, the animal Ig gene segment on the YAC is replaced with the human Ig gene segment. Alternatively, a bacterial cell such as *E. coli* is transformed with a BAC containing an animal's Ig locus or a large portion thereof. Such bacterial cell is further transformed with a recombination vector which carries a human Ig gene segment linked to a 5' flanking sequence and a 3' flanking sequence. The 5' and the 3' flanking sequences in the recombination vector mediate homologous recombination and exchange between the human Ig gene segment on the recombination vector and the animal Ig gene segment on the BAC. Humanized YACs and BACs can be readily isolated from the cells and used in making transgenic animals.

In a further aspect of the present invention, methods of making transgenic animals capable of producing humanized immunoglobulins are provided.

According to the present invention, a transgenic animal capable of making humanized immunoglobulins are made by introducing into a recipient cell or cells of an animal one or more of the transgenic vectors described herein above which carry a humanized Ig locus, and deriving an animal from the genetically modified recipient cell or cells.

The recipient cells may, for example, be from non-human animals which generate antibody diversity by gene conversion and/or hypermutation, e.g., bird (such as chicken), rabbit, cows and the like. In such animals, the 3'proximal V gene segment is preferentially used for the production of immunoglobulins. Integration of a human V gene segment into the Ig locus on the transgene vector, either by replacing the 3'proximal V gene segment of the animal or by being placed in close proximity of the 3'proximal V gene segment, results in expression of human V region polypeptide sequences in the majority of immunoglobulins. Alternatively, a rearranged human V(D)J segment may be inserted into the J locus of the immunoglobulin locus on the transgene vector.

The transgenic vectors containing a humanized Ig locus is introduced into the recipient cell or cells and then integrated into the genome of the recipient cell or cells by random integration or by targeted integration.

For random integration, a transgenic vector containing a humanized Ig locus can be introduced into an animal recipient cell by standard transgenic technology. For example, a transgenic vector can be directly injected into the pronucleus of a fertilized oocyte. A transgenic vector can also be introduced by co-incubation of sperm with the transgenic vector before fertilization of the oocyte. Transgenic animals can be developed from fertilized oocytes. Another way to introduce a transgenic vector is by transfecting embryonic stem cells and subsequently injecting the genetically modified embryonic stem cells into developing embryos. Alternatively, a transgenic vector (naked or in combination with facilitating reagents) can be directly injected into a developing embryo. Ultimately, chimeric transgenic animals are produced from the embryos which contain the humanized Ig transgene integrated in the genome of at least some somatic cells of the transgenic animal.

In a particular embodiment, a transgene containing a humanized Ig locus is randomly integrated into the genome of recipient cells (such as fertilized oocyte or developing embryos) derived from animal strains with an impaired expression of endogenous immunoglobulin genes. The use of such animal strains permits preferential expression of immunoglobulin molecules from the humanized transgenic Ig locus. Examples for such animals include the Alicia and Basilea rabbit strains, as well as Agammaglobinemic chicken strain, as well as immunoglobulin knock-out mice. Alternatively, transgenic animals with humanized immunoglobulin transgenes or loci can be mated with animal strains with impaired expression of endogenous immunoglobulins. Offspring homozygous for an impaired endogenous Ig locus and a humanized transgenic Ig locus can be obtained.

For targeted integration, a transgenic vector can be introduced into appropriate animal recipient cells such as embryonic stem cells or already differentiated somatic cells. Afterwards, cells in which the transgene has integrated into the animal genome and has replaced the corresponding endogenous Ig locus by homologous recombination can be selected by standard methods See for example, Kuroiwa et al, Nature Genetics 2004, Jun. 6. The selected cells may then be fused with enucleated nuclear transfer unit cells, e.g. oocytes or embryonic stem cells, cells which are totipotent and capable of forming a functional neonate. Fusion is performed in accordance with conventional techniques which are well established. Enucleation of oocytes and nuclear transfer can also be performed by microsurgery using injection pipettes. (See, for example, Wakayama et al., Nature (1998) 394:369.) The resulting egg cells are then cultivated in an appropriate medium, and transferred into synchronized recipients for generating transgenic animals. Alternatively, the selected genetically modified cells can be injected into developing embryos which are subsequently developed into chimeric animals.

Further, according to the present invention, a transgenic animal capable of producing humanized immunoglobulins can also be made by introducing into a recipient cell or cells, one or more of the recombination vectors described herein above, which carry a human Ig gene segment, linked to 5' and 3' flanking sequences that are homologous to the flanking sequences of the endogenous Ig gene segment, selecting cells in which the endogenous Ig gene segment is replaced by the human Ig gene segment by homologous recombination, and deriving an animal from the selected genetically modified recipient cell or cells.

Similar to the target insertion of a transgenic vector, cells appropriate for use as recipient cells in this approach include embryonic stem cells or already differentiated somatic cells. A recombination vector carrying a human Ig gene segment can be introduced into such recipient cells by any feasible means, e.g., transfection. Afterwards, cells in which the human Ig gene segment has replaced the corresponding endogenous Ig gene segment by homologous recombination, can be selected by standard methods. These genetically modified cells can serve as nuclei donor cells in a nuclear transfer procedure for cloning a transgenic animal. Alternatively, the selected genetically modified embryonic stem cells can be injected into developing embryos which can be subsequently developed into chimeric animals.

Transgenic animals produced by any of the foregoing methods form another embodiment of the present invention. The transgenic animals have at least one, i.e., one or more, humanized Ig loci in the genome, from which a functional repertoire of humanized antibodies is produced.

In a specific embodiment, the present invention provides transgenic rabbits having one or more humanized Ig loci in the genome. The transgenic rabbits of the present invention are capable of rearranging and gene converting the humanized Ig loci, and expressing a functional repertoire of humanized antibodies.

In another specific embodiment, the present invention provides transgenic chickens having one or more humanized Ig loci in the genome. The transgenic chickens of the present invention are capable of rearranging and gene converting the humanized Ig loci, and expressing a functional repertoire of humanized antibodiesin another specific embodiment, the present invention provides transgenic mice with one or more humanized V regions in the genome. The humanized V region comprises at least two human V gene segments flanked by non-human spacer sequences. The transgenic mice are capable of rearranging the human V elements and expressing a functional repertoire of antibodies.

Once a transgenic non-human animal capable of producing diversified humanized immunoglobulin molecules is made, humanized immunoglobulins and humanized antibody preparations against an antigen can be readily obtained by immunizing the animal with the antigen. A variety of antigens can be used to immunize a transgenic host animal. Such antigens include, without limitation, microorganisms, e.g. viruses and unicellular organisms (such as bacteria and fungi), alive, attenuated or dead, fragments of the microorganisms, or antigenic molecules isolated from the microorganisms.

Exemplary bacterial antigens for use in immunizing an animal include purified antigens from *Staphylococcus aureus* such as capsular polysaccharides type 5 and 8, recombinant versions of virulence factors such as alpha-toxin, adhesin binding proteins, collagen binding proteins, and fibronectin binding proteins. Exemplary bacterial antigens also include an attenuated version of *S. aureus, Pseudomonas aeruginosa, enterococcus, enterobacter*, and *Klebsiella pneumoniae*, or culture supernatant from these bacteria cells. Other bacterial antigens which can be used in immunization include purified lipopolysaccharide (LPS), capsular antigens, capsular polysaccharides and/or recombinant versions of the outer membrane proteins, fibronectin binding proteins, endotoxin, and exotoxin from *Pseudomonas aeruginosa, enterococcus, enterobacter*, and *Klebsiella pneumoniae*.

Exemplary antigens for the generation of antibodies against fungi include attenuated version of fungi or outer membrane proteins thereof, which fungi include, but are not limited to, *Candida albicans, Candida parapsilosis, Candida tropicalis*, and *Cryptococcus neoformans*.

Exemplary antigens for use in immunization in order to generate antibodies against viruses include the envelop proteins and attenuated versions of viruses which include, but are not limited to respiratory synctial virus (RSV) (particularly the F-Protein), Hepatitis C virus (HCV), Hepatits B virus (HBV), cytomegalovirus (CMV), EBV, and HSV.

Therapeutic antibodies can be generated for the treatment of cancer by immunizing transgenic animals with isolated tumor cells or tumor cell lines; tumor-associated antigens which include, but are not limited to, Her-2-neu antigen (antibodies against which are useful for the treatment of breast cancer); CD19, CD20, CD22 and CD53 antigens (antibodies against which are useful for the treatment of B cell lymphomas), (3) prostate specific membrane antigen (PMSA) (antibodies against which are useful for the treatment of prostate cancer), and 17-1A molecule (antibodies against which are useful for the treatment of colon cancer).

The antigens can be administered to a transgenic host animal in any convenient manner, with or without an adjuvant, and can be administered in accordance with a predetermined schedule.

After immunization, serum or milk from the immunized transgenic animals can be fractionated for the purification of pharmaceutical grade polyclonal antibodies specific for the antigen. In the case of transgenic birds, antibodies can also be made by fractionating egg yolks. A concentrated, purified immunoglobulin fraction may be obtained by chromatography (affinity, ionic exchange, gel filtration, etc.), selective precipitation with salts such as ammonium sulfate, organic solvents such as ethanol, or polymers such as polyethyleneglycol.

For making a monoclonal antibody, spleen cells are isolated from the immunized transgenic animal and used either in cell fusion with transformed cell lines for the production of hybridomas, or cDNAs encoding antibodies are cloned by standard molecular biology techniques and expressed in transfected cells. The procedures for making monoclonal antibodies are well established in the art. See, e.g., European Patent Application 0 583 980 A1 ("Method For Generating Monoclonal Antibodies From Rabbits"), U.S. Pat. No. 4,977,081 ("Stable Rabbit-Mouse Hybridomas And Secretion Products Thereof"), WO 97/16537 ("Stable Chicken B-cell Line And Method of Use Thereof"), and EP 0 491 057 B1 ("Hybridoma Which Produces Avian Specific Immunoglobulin G"), the disclosures of which are incorporated herein by reference. In vitro production of monoclonal antibodies from cloned cDNA molecules has been described by Andris-Widhopf et al., "Methods for the generation of chicken monoclonal antibody fragments by phage display", *J Immunol Methods* 242:159 (2000), and by Burton, D. R., "Phage display", *Immunotechnology* 1:87 (1995), the disclosures of which are incorporated herein by reference.

Cells derived from the transgenic animals of the present invention, such as B cells or cell lines established from a transgenic animal immunized against an antigen, are also part of the present invention.

In a further aspect of the present invention, methods are provided for treating a disease in a primate, in particular, a human subject, by administering a purified humanized antibody composition, preferably, a humanized polyclonal antibody composition, desirable for treating such disease.

In another aspect of the present invention, purified monoclonal or polyclonal antibodies are admixed with an appropriate pharmaceutical carrier suitable for administration in primates especially humans, to provide pharmaceutical compositions. Pharmaceutically acceptable carriers which can be employed in the present pharmaceutical compositions can be any and all solvents, dispersion media, isotonic agents and the like. Except insofar as any conventional media, agent, diluent or carrier is detrimental to the recipient or to the therapeutic effectiveness of the antibodies contained therein, its use in the pharmaceutical compositions of the present invention is appropriate. The carrier can be liquid, semi-solid, e.g. pastes, or solid carriers. Examples of carriers include oils, water, saline solutions, alcohol, sugar, gel, lipids, liposomes, resins, porous matrices, binders, fillers, coatings, preservatives and the like, or combinations thereof.

The humanized polyclonal antibody compositions used for administration are generally characterized by containing a polyclonal antibody population, having immunoglobulin concentrations from 0.1 to 100 mg/ml, more usually from 1 to 10 mg/ml. The antibody composition may contain immunoglobulins of various isotypes. Alternatively, the antibody composition may contain antibodies of only one isotype, or a number of selected isotypes.

In most instances the antibody composition consists of unmodified immunoglobulins, i.e., humanized antibodies prepared from the animal without additional modification, e.g., by chemicals or enzymes. Alternatively, the immunoglobulin fraction may be subject to treatment such as enzymatic digestion (e.g. with pepsin, papain, plasmin, glycosidases, nucleases, etc.), heating, etc, and/or further fractionated.

The antibody compositions generally are administered into the vascular system, conveniently intravenously by injection or infusion via a catheter implanted into an appropriate vein. The antibody composition is administered at an appropriate rate, generally ranging from about 10 minutes to about 24 hours, more commonly from about 30 minutes to about 6 hours, in accordance with the rate at which the liquid can be accepted by the patient. Administration of the effective dosage may occur in a single infusion or in a series of infusions. Repeated infusions may be administered once a day, once a week once a month, or once every three months, depending on the half-life of the antibody preparation and the clinical indication. For applications on epithelial surfaces the antibody compositions are applied to the surface in need of treatment in an amount sufficient to provide the intended end result, and can be repeated as needed. In addition, antibodies can, for example, be administered as an intramuscular bolus injection, which may, but does not have to, be followed by continuous administration, e.g. by infusion.

The antibody compositions can be used to bind and neutralize antigenic entities in human body tissues that cause disease or that elicit undesired or abnormal immune responses. An "antigenic entity" is herein defined to encompass any soluble or cell-surface bound molecules including proteins, as well as cells or infectious disease-causing organisms or agents that are at least capable of binding to an antibody and preferably are also capable of stimulating an immune response.

Administration of an antibody composition against an infectious agent as a monotherapy or in combination with chemotherapy results in elimination of infectious particles. A single administration of antibodies decreases the number of infectious particles generally 10 to 100 fold, more commonly more than 1000-fold. Similarly, antibody therapy in patients with a malignant disease employed as a monotherapy or in combination with chemotherapy reduces the number of malignant cells generally 10 to 100 fold, or more than 1000-fold. Therapy may be repeated over an extended amount of time to assure the complete elimination of infectious particles, malignant cells, etc. In some instances, therapy with antibody preparations will be continued for extended periods of time in the absence of detectable amounts of infectious particles or undesirable cells. Similarly, the use of antibody therapy for the modulation of immune responses may consist of single or multiple administrations of therapeutic antibodies. Therapy may be continued for extended periods of time in the absence of any disease symptoms.

The subject treatment may be employed in conjunction with chemotherapy at dosages sufficient to inhibit infectious disease or malignancies. In autoimmune disease patients or transplant recipients, antibody therapy may be employed in conjunction with immunosuppressive therapy at dosages sufficient to inhibit immune reactions. The invention is further illustrated, but by no means limited, by the following examples.

EXAMPLE 1

Isolation and Sequencing of BAC Clones Containing Rabbit Immunoglobulin Loci

High molecular weight DNA was isolated from a2b5 male rabbits. The rabbits were euthanized, spleen and kidneys were removed and rinsed in ice-cold PBS. Fat and connecting tissues were removed and processed separately. The organs were cut into pieces and homogenized in a pre-cooled Dounce homogenizer. The supernatant was transferred into cooled 50 ml falcon tubes, mixed with cold PBS and large tissue debris was allowed to sink to the bottom for 2 minutes. Cells in the supernatant were pelleted at 200 g for 10 min at 4° C., washed once with PBS, resuspended in 1 ml PBS and counted. Sets of $5 \times 10^6$, $5 \times 10^7$ and $5 \times 10^8$ cells were embedded in agarose plugs using the CHEF Mammalian Genomic DNA Plug Kit (BIORAD) To optimize conditions for partial digestion with HindIII, plugs were cut into 5 equal pieces and digested with 1 to 10 units of HindIII for various times and temperatures. Best results were obtained with 2 units HindIII at 4° C. for 3 hrs or 37° C. for 25 min. Digested DNA was double size fractioned on a Pulse Field Gel Electrophoresis (PFGE) apparatus using the following parameters: 6 hr backwards, 15 s switch times; 6 hr forwards, 15 s switch times; 20 hr forwards, 90 s switch times; 200V 14° C. The area of the gel with the desired size of partial digested DNA was cut and DNA was isolated using gelase. 11 ng of insert was ligated with 1 ng of HindIII digested pBELOBAC 11 and electroporated into DH10B cells. 1% of the resulting colonies was sized using NotI and revealed an average insert size of 124 kb. $1 \times 10^5$ clones were spotted on Nylon filters and screened by hybridization with specific probes.

Probes for screening were amplified by PCR using genomic DNA from rabbits, cloned into pBlueScript, and verified by sequencing. Primer pairs (SEQ ID NO: 193-208, Table 2) were designed according to published sequences. Several BACs representing rabbit heavy and light chain immunoglobulin loci were isolated and mapped (FIGS. 1 and 5). BACs 219D23 219D23 (GenBank Acc. No. AY386695), 225P18 (GenBank Acc. No. AY386697), 27N5 (GenBank Acc. No. AY386696), 38A2 (GenBank Acc. No. AY386694), 179L1 (GenBank Acc. No. AY495827), 215M22 (GenBank Acc. No. AY495826), 19 (GenBank Acc. No. AY495828) and Fosmid Fos15B (GenBank Acc. No. AY3866968) were sequenced. Shotgun libraries for sequencing were constructed in pCR-Blunt with an insert size of 1.5-2 kb. For sequence analysis the STADEN package (Roger Staden, Cambridge, UK) was used. The software modules pregap and gap4 were used for assembly and gap closure. For the quality clipping of sequences PHRED (Washington University) and the STADEN package was coupled.

EXAMPLE 2

Construction of a Humanized Rabbit Immunoglobulin Heavy Chain Locus

BAC and fosmid clones containing rabbit immunoglobulin heavy chain locus sequences were isolated from genomic DNA libraries using probes specific for the constant, variable, and joining gene segments or the 3' enhancer region. Isolated BACs (FIG. 1) 27N5 (GenBank Acc. No. AY386696), 219D23 (GenBank Acc. No. AY386695), 225P18 (GenBank Acc. No. AY386697), 38A2 (GenBank Acc. No. AY386694) and fosmid Fos15B (GenBank Acc. No. AY3866968) were sequenced (Ros et al., *Gene* 330, 49-59).

Selected immunoglobulin coding sequences were exchanged with corresponding human counterparts by homologous recombination in *E. Coli* by ET cloning (E-Chiang Lee et al., *Genomics* 73, 56-65 (2001); Daiguan Yu et al., *PNAS* 97, 5978-5983 (2000); Muyrers et al., *Nucleic Acids Research* 27, 1555-1557 (1999); Zhang et al., *Nature Biotechnology* 18, 1314-1317 (2000)).

Alternatively, DNA fragments were recombined by ligation in vitro and subsequent transformation of *E. coli*. BACs and/or Fos15B or parts thereof were combined by in vitro ligation and transformation, ET cloning, or by Cre recombinase mediated integration.

For ET cloning, vectors containing target sequence were transformed into a streptomycin resistant *E.coli* strain containing the inducible lambda phage recombination enzymes Redα, Redβ and γ. These recombination proteins were expressed either from a co-transfected plasmid (DH10B *E. coli* cells with plasmid pSC101) or from a genomic integrated lambda prophage (DY380 *E. coli* strain). The ET cloning procedure encompassed two homologous recombination steps.

In a first step the target locus was replaced by a selection-counter selection cassette (e.g. neo-rpsL which confers resistance to neomycin (neo) and sensitivity to streptomycin (rpsL)). After isolation of neo-resistant colonies, insertion of the selection cassette by homologous recombination was confirmed by restriction enzyme analysis and partial sequencing.

In a second step, the rpsL-neo selection cassette was exchanged with a new sequence. Streptomycin resistant clones were analyzed by restriction analysis and sequencing. Fragments used for the ET cloning procedure had flanking sequences of 20 to 50 bp length, which were identical to target sequences. Sequences used for ligation had appropriate restriction enzyme sites at their 3' and 5'ends. These sites were either naturally occurring sites or they were introduced by PCR using primers containing appropriate sites.

Alternatively, sequences were generated synthetically.

A humanized heavy chain was constructed by replacement of rabbit $J_H$, Cμ in BAC 219D23 and Cγ in BAC 27N5 with their corresponding human counterparts by ET cloning. Human sequences used for the ET cloning procedures were amplified by PCR from human genomic DNA.

Human Cμ, Cγ and $J_H$ gene segments was amplified using primers (SEQ ID Nos: 209-214, Table 2) with 50 bp homologies to rabbit target sequences.

After ligation of BAC clone 225P18 with clone 219D23 and BAC 27N5 with Fosmid 15B, the ligated constructs were transformation into *E. coli* and connected by Cre recombinase mediated insertion. This resulted in a functional locus consisting of 18 rabbit variable genes, rabbit D region, human J region, human Cμ, human Cγ, rabbit Cε, rabbit Cα4 and the 3'enhancer element.

For the generation of transgenic animals the humanized BAC clones were coinjected either separately as three overlapping BACs (225P18 and 219D23 and BAC 27N5) or two overlapping combined BACs (225P18-219D23 and BAC 27N5-Fosmid 15B) or as one BAC (225P18-219D23-27N5-Fosmid 15B). Founder animals with transgenes were identified by PCR.

EXAMPLE 3

Figure 13E:
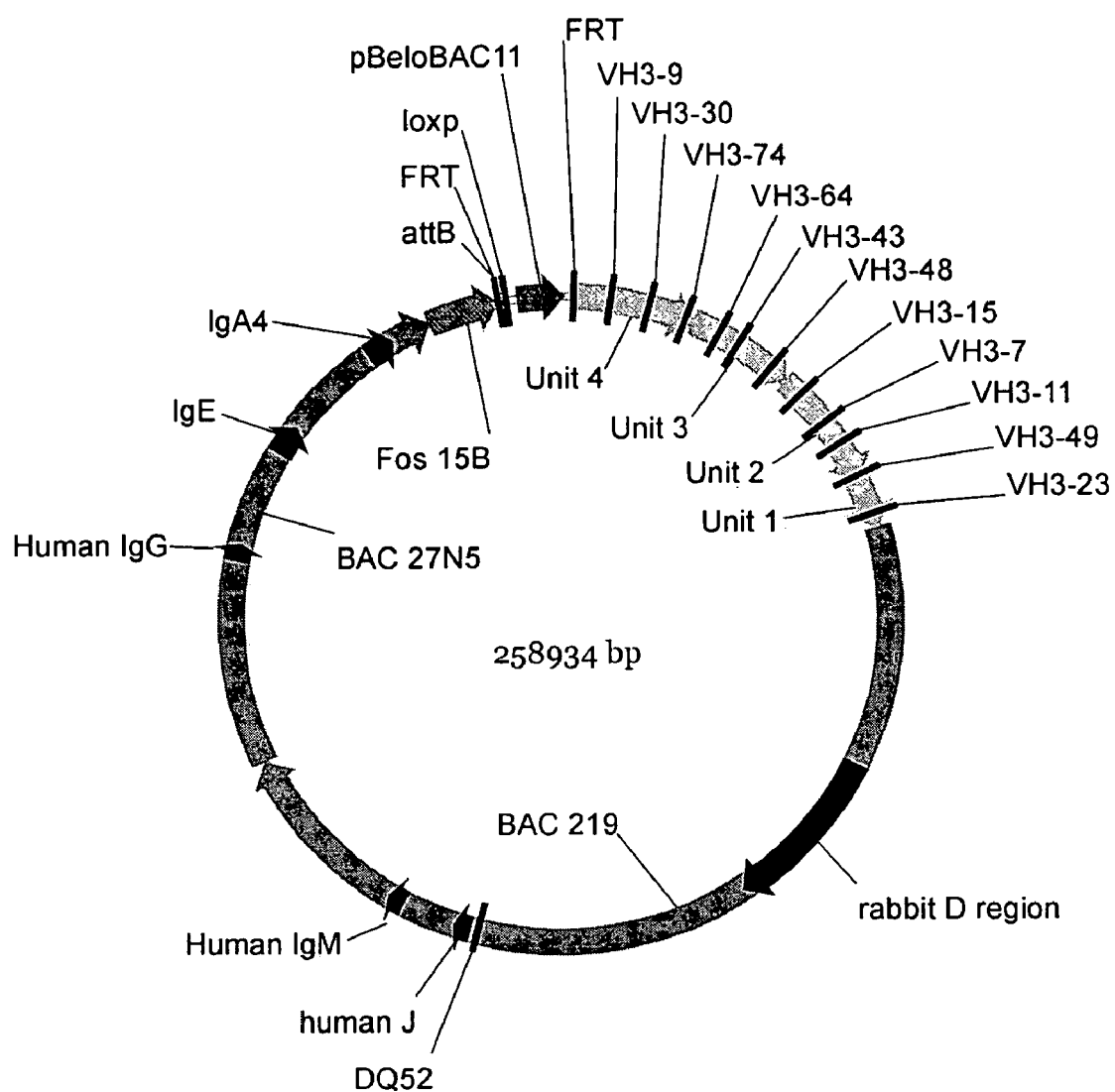

Construction of a Humanized Immunoglobulin Heavy Chain Locus Using Synthetic Fragments Four fragments denoted Unit1, Unit2, Unit3, and Unit 4 (FIG. 13, SEQ ID Nos: 189-192) with human V sequences and rabbit spacers were chemically synthesized. Each fragment was flanked 5' by an AscI restriction endonuclease recognition sequence, 3' by a lox71 Cre recombinase recognition sequence followed by Fse I and MluI restriction enzyme recognition sequences. Unit 1 consisted of human $V_H3$-49, $V_H3$-11, $V_H3$-7 and $V_H3$-15 variable genes separated by rabbit spacers I29-30, I3-4, I2-3 and the 3' half of I1-2 (I1-2B). Unit 2 consisted of human $V_H3$-48, $V_H3$-43 and $V_H3$-64 separated by rabbit spacers I1-2A (5' half of I1-2), I7-8, I6-7 and the 3' half of I4-5 (I4-5B). Unit 3 consisted of human $V_H3$-74, $V_H3$-30, and $V_H3$-9 separated by the rabbit spacer sequences I4-5B, I26-27, I11-12 and I17-18.

Unit 3 had in addition to the afore mentioned upstream flanks an Flp recombinase recognition target (FRT) sequence, followed by a SgIf I restriction endonuclease recognition sequence preceding the already mentioned Asc I site.

Unit 4 had the human $V_H3$-23 gene 5' flanked by the rabbit spacer I1-2, a lox66 Cre recombinase target sequence and an AscI endonuclease recognition sequence, and 3' flanked by IV-C (5' half) rabbit spacer sequence followed by a MluI endonuclease recognition sequence.

A gentamycin selection cassette was PCR-amplified, using primers SEQ ID NOs 215 and 216 (Table 2) containing AscI and FseI sites and ligated into a pGEM vector with a modified cloning site including AscI, FseI, and MluI endonuclease recognition sites (pGEM.Genta modified by PCR using SEQ ID NOs 217 and 218, Table 2).

Units 1, 2 and 3 were cloned into pGEM.Genta (Promega) vectors.

Unit 4 was sub-cloned into a customized pBELOBAC11 (NEB) vector linearized with Hind III, and PCR-amplified. The forward primer (SEQ ID NO: 219, Table 2) had restriction sites for HindIII, PacI and AatII, and the reverse primer (SEQ ID NO: 220) sites for Bam HI, MluI and AscI. The primers were designed in such a way that the pBELOBAC11 Chloramphenicol selection cassette was deleted. Furthermore, a Neomycin selection cassette was PCR-amplified with primers SEQ ID NOs 221 and 222 (Table 2) carrying Bam HI and Hind III restriction sites and ligated to the modified pBELOBAC11 vector (pBB11.1).

Units 1-4 were assembled by cre-mediated recombination as described (Mejia et al, *Genomics* 70(2) 165-70 (2000)). First Unit 1 was cloned into the customized pgem.Genta vector, digested with Fse I and subsequently recircularized by ligation. This vectorless construct was transformed into *E. coli* containing pBB11.1.Unit4 and p706-Cre plasmid. Following recombination of Unit 1 with PBB11.1 unit 4, positive clones (Unit4/1) were selected on kanamycin and gentamycin containing media. Clones were characterized by restriction analyses using various enzymes.

For recombination of Unit 2, the Unit4/1 insert was excised by double digestion with AscI and PacI, and cloned into pBELOBAC11 with a modified linker (pBB11.2: modified by PCR using primers SEQ ID NOs 223 and 224, Table 2).

pBELOBAC11 was linearized with HindIII and PCR-amplified with a forward primer encoding PacI and AatII endonuclease recognition sites and a reverse primer encoding MluI and NotI endonuclease recognition sites and a lox66 Cre recombinase target site. For ligation with Unit1/4 the pBB11.2 vector was opened with MluI and PacI. pGEM.Genta.Unit2 was converted into a circular vectorless construct as described for pGEM.Genta.Unit1 and connected with pBB11.2.Unit4/1 by in vivo Cre mediated recombination. Subsequently, the resulting construct pBB11.2.Unit4/1/2 is prepared for Cre mediated recombination with Unit 3 by replacing the wild type loxp site with a lox66 target site by ET-cloning (Muyers et al., *Nucleic Acids Research* 27, 1555-1557 (1999); Muyers et al *Trends Biochem. Sci.* 26(5):325-31 (2001)). A chloramphenicol selection cassette was amplified by PCR with primers (SEQ ID NOs 225 and 226, Table 2) containing 50 bp sequences homologous to the BAC target sequence. The reverse primer included a lox66 site. The gel-purified PCR product was transformed into cells carrying the target BAC as well as the pSC101 plasmid, required for homologous recombination. Positive clones were selected with chloramphenicol and confirmed by restriction analysis and sequencing. pGEM.Genta.Unit 3 was prepared for in vivo recombination as described above for Unit1 and 2 and transformed into cells carrying the receptor BAC, as well as the p706-Cre plasmid. Positive clones pBB11.2.Unit4/1/2/3 were selected with gentamycin and confirmed by restriction analysis. pBB11.2.Unit4/1/2/3 was further modified by ET-cloning to generate a lox 71 target site. Subsequently, pBB11.2.Unit4/1/2/3 was connected to fragments from BACs 219D23, 27N5 and Fos15B.

EXAMPLE 4

Construction of a Humanized Immunoglobulin Heavy Chain Locus Using PCR Amplified Fragments Human $V_H$ elements were amplified using genomic DNA (ClonTech) and primers SEQ ID NOs 227-248 (Table 2). PCR products were analyzed by gel-electrophoresis and gel purified using the GENECLEAN kit (Q-Biogen). Subsequently, amplification products were sub-cloned into Zero-Blunt TOPO™ (Invitrogen), according to the manufacturer's instructions. The sequences of all amplified V elements were confirmed. For the construction of the humanized V region, V elements were amplified using plasmid DNA as template and primers SEQ ID NOs 249-270 (Table 2). Forward primers contained an AscI site, followed by a rabbit splice site. Reverse primers contained a rabbit recombination signal sequence (RSS) and a MluI restriction site. PCR products were gel purified using the GENECLEAN kit.

Human $V_H$s, V3-33, V3-74, V3-49, V3-21, V3-48, V3-73, V3-7, and V3-D could not be isolated by PCR and were synthesized chemically (BlueHeron, Bothel, Wash.). Restriction sites and rabbit regulatory sequences were added during synthesis.

Rabbit spacer sequences were amplified using BACs 38A2 and 225P18 as templates and primers SEQ ID NOs 271-288 (Table 2). BAC 225P18 was double digested with NheI and a 41 kb fragment was gel purified. This fragment served as a template for the amplification of spacers V1-2, V2-3, V3-4, V4-5, and V5-6.

BAC 225P18 was digested with BstBI and the template for spacers V6-7 and V7-8 was gel-purified. A double digestion of BAC 38A2 with PacI and RsrII allowed gel purification of the template for spacers V21-22, and V22-23.

Amplified spacer sequences were gel-purified, and sub-cloned into XL-PCR-TOPO™ (Invitrogen) according to the manufacturer's instructions.

$V_H$ elements and rabbit spacer sequences were sub-cloned into modified pGEM (Promega) and pBS (Strategene) vectors. The pGEM vector was cut with NotI and Hind III and ligated with chemically synthesized oligonucleotide sequences containing FseI, AscI and MluI sites (Oligo1: SEQ ID NO: 289; Oligo2: SEQ ID NO: 290; Table 2). Vector pBS was cut with SacI and KpnI and ligated with a chemically synthesized oligonucleotide sequence containing the restriction sites FseI, AscI and MluI (Oligo1: (SEQ ID NO: 291; Oligo2: SEQ ID NO: 292, Table 2).

Gentamycin and neomycin selection cassettes were amplified using primers (SEQ ID NOs: 293-296, Table 2) with Fse I or AscI sites and ligated into the modified pGEM and pBS-vectors.

The final construct is built in a modified pBeloBAC II vector. The pBeloBAC II vector was opened with BamHI and HindIII and the cloning sites were modified to contain FseI, AscI, MluI sites using a chemically synthesized oligonucleotide sequence (Oligo1: SEQ ID NO: 297; Oligo2: SEQ ID NO: 298, Table 2).

BAC 219D23 was modified by introduction of restriction sites using ET-cloning (Muyrers et al., *Nucleic Acids Research* 27, 1555-1557 (1999); Muyers et al *Trends Biochem. Sci.* 26(5):325-31 (2001)). The Neomycin selection cassette was amplified with primers SEQ ID NO: 299 and SEQ ID NO: 300 (Table 2). The forward primer contained an FseI site, the reverse primer an AscI site.

The purified PCR product was transformed into *E. coli* cells carrying BAC 219D23 and plasmid pSC101 necessary for homologous recombination. After homologous recombination of the cassette and the target sites in the BAC, introduced restriction sites were confirmed by restriction analysis. Subsequently, the modified BAC 219D23 was digested with FseI and MluI and the resulting 17 kb fragment (containing the FseI-Neo-AscI cassette) was separated by PFGE and purified by electro-elution. This purified fragment was ligated with the modified pBeloBAC II vector opened with FseI and MluI.

Figure 6:
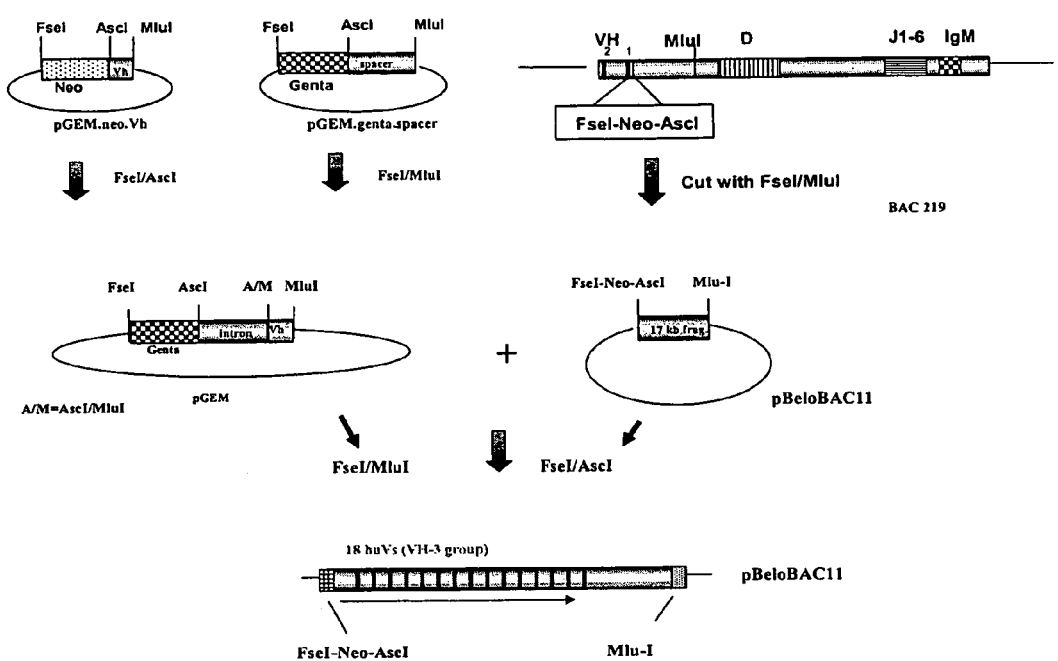
FIG. 6 illustrates the building of an immunoglobulin gene V locus using human $V_H$ and rabbit spacer elements.

A purified DNA fragment encoding a human $V_H$ element is ligated with the modified pGEM.neo vector opened with AscI and MluI. Similarly a spacer sequence is sub-cloned into the modified pGEM.genta vector. Subsequently, the pGEM.genta vector carrying the spacer sequence is cut with FseI and MluI and the insert is ligated with pGEM.neo. $V_H$ vector opened with FseI and AscI. This step is repeated several times to build a fragment consisting of several spacer and $V_H$ segments. Such fragments are excised with FseI and MluI and ligated with the modified pBeloBAC II vector linearized with FseI and AscI. These processes are repeated to build a large immunoglobulin V region (FIG. 6). The humanized heavy chain locus is used for the generation of transgenic animals.

EXAMPLE 5

Construction of a Humanized Rabbit Light Chain Locus Containing Humanized Cκ and Humanized Rearranged VJ Screening of a rabbit genomic BAC libraries resulted in the identification of three BACs (215M22, 179L1 and 196O2; Gene Bank Accession Nos: AY495826, AY495827, and AY495828, respectively) containing rabbit light chain K1 gene segments. Rabbit Cκ1 was exchanged with human Cκ allotype Km3 by ET cloning as described (E-Chiang Lee et al., *Genomics* 73, 56-65 (2001); Daiguan Yu et al., *PNAS* 97, 5978-5983 (2000); Muyrers et al., *Nucleic Acids Research* 27, 1555-1557 (1999); Zhang et al., *Nature Biotechnology* 18, 1314-1317 (2000)). Human Cκ (allotype Km3) was amplified by PCR with primers (SEQ ID Nos 301 and 302, Table 2) containing 50 bp sequences homologous to target sequences. Homology arms were designed based on the published sequence of rabbit germline kappa (b5; GenBank Accession No. K01363) and matched the intron-exon boundary of Cκ. The exchange of rabbit Cκ against the human Cκ in BAC 179L1 was verified by sequencing.

BAC 179L1-huCk was modified by two ET cloning. A neomycin selection cassette was amplified with primers (SEQ ID NOs 303 and 304, Table 2) containing 50 bp sequences homologous to BAC 179L1. The forward primer additionally had an i-CeuI meganuclease site. The PCR product was used for ET cloning. Positive clones were selected with neomycin and checked for correctness by restriction enzyme digests and sequencing. A zeocin selection cassette was amplified with primers (SEQ ID NOs 305 and 306, Table 2) containing 50 bp sequences homologous to BAC 179L1. The forward primer additionally had an i-SceI meganuclease site. The PCR product was used for ET cloning. Positive clones were selected with zeozin and checked for correctness by restriction enzyme digests and sequencing.

BAC 215M22 was modified by one ET cloning. A gentamycin resistance gene was amplified with primers (SEQ ID NOs 307 and 308, Table 2) containing 50 bp sequences homologous to BAC215M22. The forward primer additionally had an i-CeuI Meganuclease site and the reverse primer an i-SceI meganuclease site. The PCR product was used for ET cloning. Resulting clones were selected with gentamycin and analyzed by restriction enzyme digests and sequencing.

Modified BAC179L1 and 225M22 were cut with i-CeuI and i-SceI. Fragments of 98 kb and 132 kb were purified and ligated. Resulting clones were selected with kanamycin and chloramphenicol and checked for correctness by restriction enzyme digests, PCR of the regions containing i-SceI and i-CeuI restriction sites, and sequencing. The resulting BAC was termed 179-215-huCk.

Rabbit Jκ1 and Jκ2 of BAC 179-215-huCk were replaced by ET cloning with a synthetic human rearranged VκJκ gene. A DNA fragment with rabbit promoter, rabbit leader, rabbit intron and human VκJκ gene was synthesized chemically. The codon usage of the synthetic human VJ was optimised to achieve highest DNA sequence homology to rabbit V kappa genes.

The synthetic human VJ was PCR amplified with a forward primer (SEQ ID NO 309, Table 2) containing 50 bp sequences homologous to BAC 179L1 and a reverse primer (SEQ ID NO 310, Table 2) containing a sequence homologous to the gentamycin resistance gene and a FRT site. A gentamycin resistance gene was amplified with a forward primer (SEQ ID NO 311, Table 2) containing a FRT site and a reverse primer (SEQ ID NO 312, Table 2) with 50 bp homology to BAC 179L1 and a FRT site. The human synthetic human VJ and the gentamycin resistance gene were combined by overlap extension PCR using the forward primer for the synthetic human VJ gene and the reverse primer for the gentamycin resistance gene. The resulting fragment was used for ET cloning. Positive clones were selected with gentamycin and checked for correctness by restriction enzyme digests and sequencing.

The gentamycin resistance gene was removed by site specific recombination via expression of Flp recombinase. After recombination one FRT was left. The FRT site was deleted by ET cloning. A 232 bp fragment from the synthetic human VJ was amplified by PCR (using primers SEQ ID NOs 313 and 314, Table 2) and used for ET cloning. Resulting colonies were screened by PCR (using primers SEQ ID NOs 315 and 316, Table 2) for loss of the FRT site and confirmed by sequencing.

The neomycin resistance gene of BAC179-215-huCk was replaced by ET cloning. A gentamycin resistance (pRep-Genta; Genebridges) gene was amplified by PCR with primers (SEQ ID NOs 317 and 318, Table 2) containing 50 bp sequences homologous to BAC 179-215-huCk. The forward primer aditionally had a loxP site, an attB site and a PvuI restriction site. Resulting clones were selected with gentamycin and checked for correctness by restriction enzyme digests and sequencing.

Figure 8:
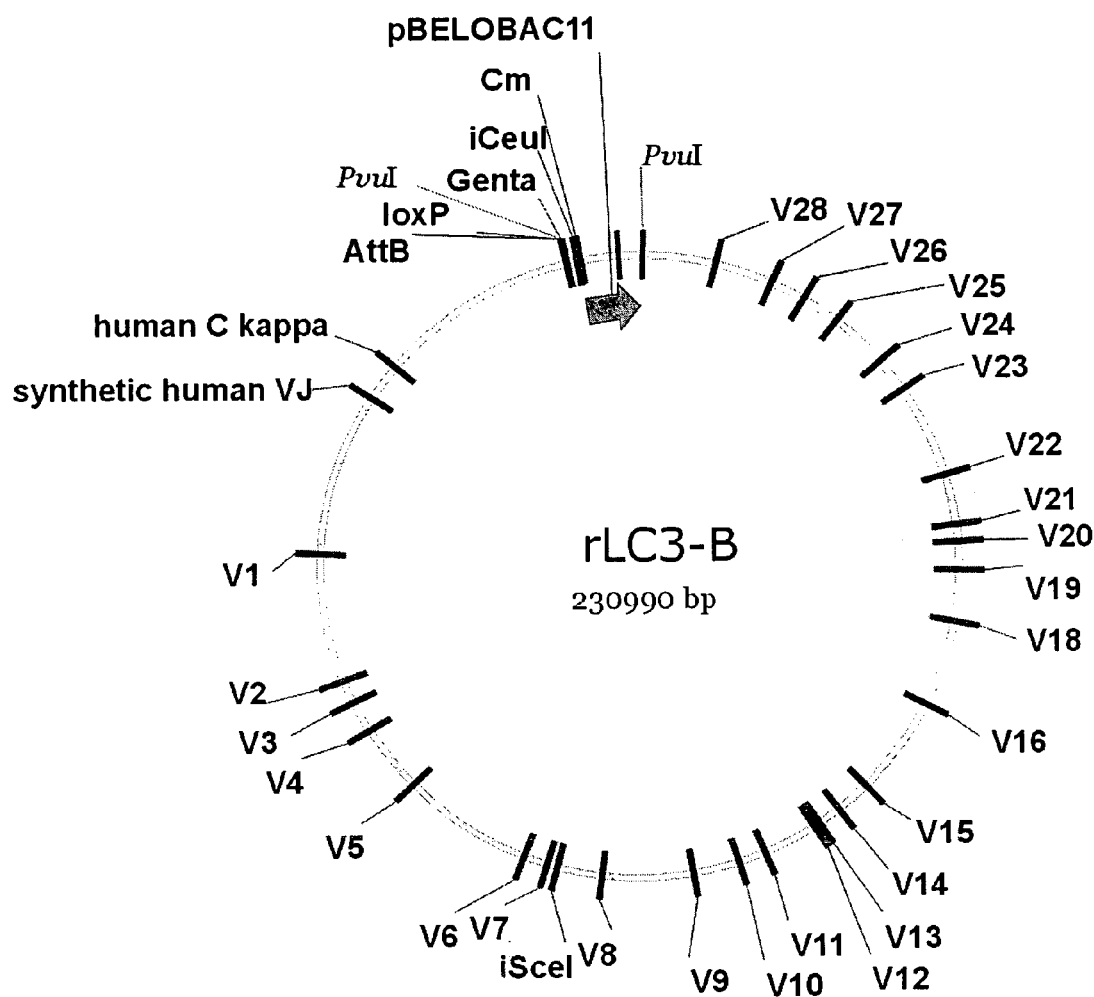
FIG. 8 shows a humanized rabbit light chain locus (rLC3-B) based on the rabbit K1 light chain locus. Rabbit Cκ1 was replaced with human Cκ. A human rearranged human VκJκ was inserted. The synthetic human VκJκ shares more than 80% sequence homology with rabbit Vκ elements.

The resulting BAC (rLC3-B; FIG. 8) was used for the generation of transgenic animals.

EXAMPLE 6

Construction of a Humanized Rabbit Light Chain Locus Containing Multipe Human Vk Elements, Chicken Spacer Elements and a Rearranged Human VJ Screening of a rabbit genomic BAC libraries resulted in the identification of three BACs (215M22, 179L1 and 19602; Gene Bank Accession Nos: AY495826, AY495827, and AY495828, respectively) containing rabbit light chain K1 gene segments. Rabbit Cκ1 was exchanged with human Cκ allotype Km3 by ET cloning as described (E-Chiang Lee et al., *Genomics* 73, 56-65 (2001); Daiguan Yu et al., *PNAS* 97, 5978-5983 (2000); Muyrers et al., *Nucleic Acids Research* 27, 1555-1557 (1999); Zhang et al., *Nature Biotechnology* 18, 1314-1317 (2000)). Human Cκ (allotype Km3) was amplified by PCR with primers (SEQ ID Nos 301 and 302, Table 2) containing 50 bp sequences homologous to target sequences. Homology arms were designed based on the published sequence of rabbit germline kappa (b5; GenBank Accession No. K01363) and matched the intron-exon boundary of Cκ. The exchange of rabbit Cκ against the human Cκ in BAC 179L1 was verified by sequencing.

Figure 12C:
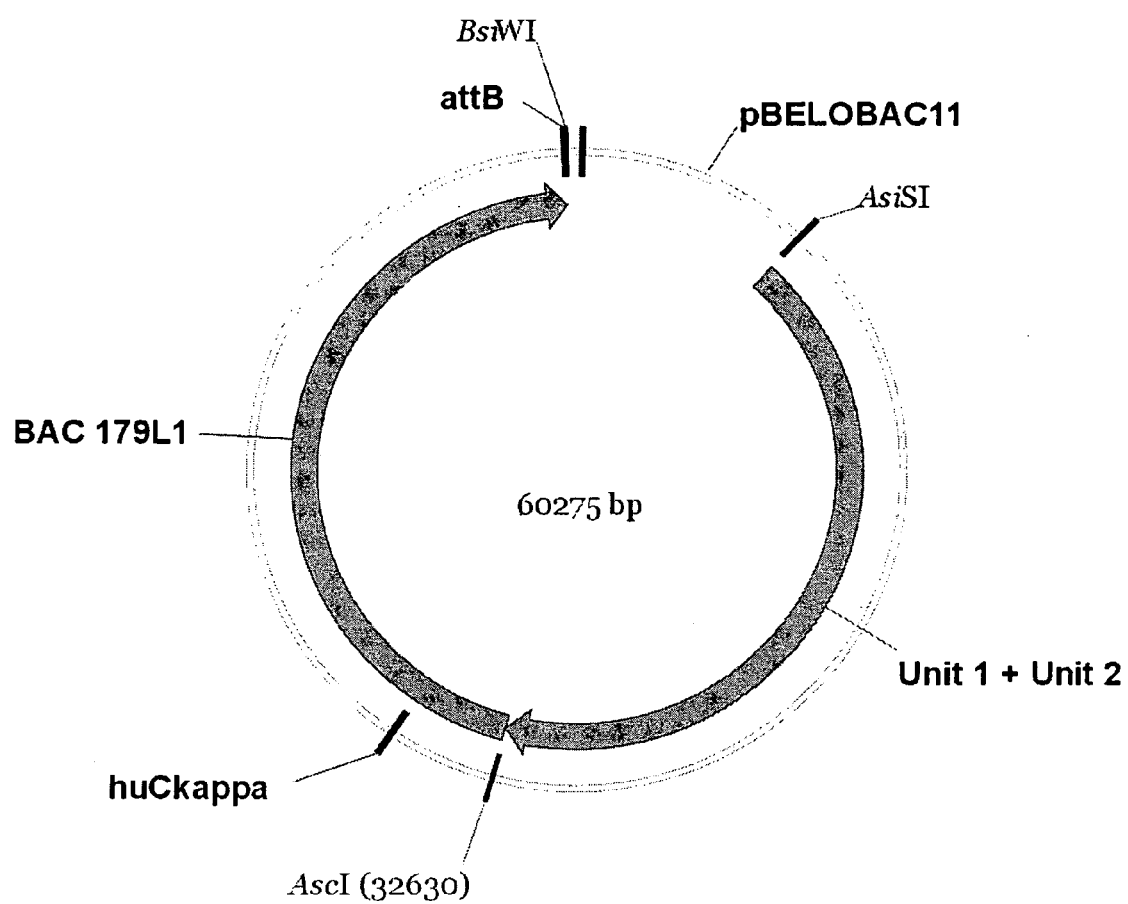

Two DNA fragments, Unit1 (12,235 bp, FIG. 12*a*, SEQ ID NO 187) containing 17 human V pseudogenes and 18 chicken spacer sequences and Unit 2 (13,283 bp, FIG. 12*b*, SEQ ID NO 188) containing one functional rearranged human kappa VJ gene with leader, 11 human V pseudogenes, 12 chicken spacer sequences and intron 1 and parts of intron 2 were synthesized chemically and cloned into vector pBR322.

Units 1 and 2 were digested with the restriction enzyme NgoMIV and AsiSI or NgoMIV and AscI respectively and ligated into pBELOBAC11 with a modified linker by three fragment ligation. The modified linker contained a BsiWI restriction site, a FRT5-site, a rpsL-Neo-cassette, a AscI site and a AsiSI-site. The linker fragment was amplified with High fidelity polymerase (Roche), primers CE_1_001_012904 (SEQ ID NO 319, Table 2) and CE_1_on005_013004 (SEQ ID NO 320, Table 2) and plasmid pRpsL-Neo (Genebridges) as template. Subsequently, the amplified product was ligated into BamHI and HindIII sites of pBELOBAC11. For ligation with Unit 1 and 2 the modified pBELOBAC11 was opened with AsiSI and AscI. Positive clones (pBELOBAC11 Unit1/2) were checked by restriction enzyme digests.

BAC 179L1 (GENBANK Acc. No. AY495827) was modified by insertion of two modified selection cassettes by ET cloning. Cassette 1 was a gentamycin resistance gene amplified with primers (SEQ ID Nos 321 and 322, Table 2) containing 50 bp sequences homologous to BAC 179L1 and an AscI site in the reverse primer. Cassette 2 was a rpsl-Neo selection cassette amplified with primers (SEQ ID Nos 323 and 324, Table 2) containing 50 bp sequences homologous to BAC 179L1 and an attB site, a FRT5 site and a BsiWI site in the forward primer.

The purified PCR products were transformed into *E. coli* cells carrying the BAC and plasmid pSC101 necessary for homologous recombination. After homologous recombination successful modification of the BAC was confirmed by restriction digest analyses, Southern Blot and sequencing.

Modified BAC 179L1 was cut with the restriction enzymes AscI and BsiWI. The fragment containing the human Cκ was purified and ligated with pBELOBAC11 Unit1/2 opened with the same restriction enzymes. Positive clones were checked by restriction enzyme digests. The final construct (FIG. 12c) is used for the generation of transgenic animals.

EXAMPLE 7

Construction of a Humanized Rabbit Light Chain Locus Containing Multipe Human Vκ Elements, Chicken Spacers and an Unrearranged Human J Kappa Locus The construct described in example 6 was modified by ET cloning as follows:an. The rearranged functional VJ sequence was exchanged with a functional V1 flanked by a functional recombination signal sequence (RSS). The RSS was PCR amplified from BAC179L1 with a forward primer (SEQ ID NO 325, Table 2) containing a 50 bp sequence homologous to V1 of pBELOBAC11 Unit1/2 and a reverse primer (SEQ ID NO 326, Table 2) containing an AscI restriction enzyme site and homology to the gentamycin resistance gene. A gentamycin resistance gene was amplified with a forward primer (SEQ ID NO 327, Table 2) containing a sequence homologous to the reverse primer used for RSS amplification and a reverse primer (SEQ ID NO 328, Table 2) containing a 50 bp sequence homologous to pBELOBAC11 Unit1/2 and a BsiWI restriction enzyme site.

The RSS and the gentamycin resistance gene were combined by overlap extension PCR using the forward primer for RSS amplification and the reverse primer for Gentamycin resistence gene amplification. The resulting fragment was used to modify pBELOBAC11 Unit1/2 by ET cloning. Positive clones were selected with gentamycin and analyzed by restriction enzyme digests and sequencing.

BAC 179L1 with human Cκ was further modified by ET cloning. A kanamycin selection cassette was amplified with a primers (SEQ ID NO 329 and 330, Table 2) containing 50 bp sequences homologous to BAC 179L1. The reverse primer contained also an AscI restriction enzyme site and a FRT site. The PCR product was used for ET cloning. An ampicillin selection cassette was amplified with primers (SEQ ID Nos 331 and 332, Table 2) containing 50 bp sequences homologous to BAC 179L1. The forward primer contained also an attB site, an AsiSI restriction enzyme site and a FRT5 site The reverse primer contained a BsiWI restriction enzyme site and a FRT site. The PCR product was used for ET cloning. The human J region was amplified from human genomic DNA with primers (SEQ ID Nos 333 and 334, Table 2) containing 50 bp sequences homologous to BAC 179L1. The PCR product was used for ET cloning. The resulting clones were analyzed by restriction enzyme digest and sequencing.

A positive clone was cut with AscI and BsiWI. The resulting fragment was purified and ligated into the modified pBELOBAC11 Unit1/2 cut with the same enzymes. Positive clones were selected with ampicillin and analyzed by restriction enzyme digests and sequencing. Correct clones are used to generate transgenic animals.

EXAMPLE 8

Construction of a Humanized Rabbit Light Chain Locus Containing Multipe Human Vk Elements.

Screening of a rabbit genomic BAC libraries resulted in the identification of three BACs (215M22, 179L1 and 196O2; Gene Bank Accession Nos: AY495826, AY495827, and AY495828, respectively) containing rabbit light chain K1 gene segments. Rabbit Cκ1 was exchanged with human Cκ allotype Km3 by ET cloning as described (E-Chiang Lee et al., *Genomics* 73, 56-65 (2001); Daiguan Yu et al., *PNAS* 97, 5978-5983 (2000); Muyrers et al., *Nucleic Acids Research* 27, 1555-1557 (1999); Zhang et al., *Nature Biotechnology* 18, 1314-1317 (2000)). Human Cκ (allotype Km3) was amplified by PCR with primers (SEQ ID NOs 301 and 302, Table 2) containing 50 bp sequences homologous to target sequences. Homology arms were designed based on the published sequence of rabbit germline kappa (b5; GenBank Accession No. K01363) and matched the intron-exon boundary of Cκ. The exchange of rabbit Cκ against the human Cκ in BAC 179L1 was verified by sequencing.

Human Vκ elements of the Vκ1 family (O2, L8, L4, A30, L11, L1, L5, L15, O8, L19, L12, A20, O4, L14, L23, L9, A4, L24, O6, L22, A9, A25, A15, O9) were amplified by PCR using primers (SEQ ID NOs 335-382, Table 2) and human genomic DNA as a template.

Amplification products were analysed by gel-electrophoresis, gel purified using GENECLEAN (Q-Biogen), subcloned into the Zero-Blunt TOPO™ vectors (Invitrogen) and sequenced. A rearranged human Vκ (O2) Jκ (J4) element was produced by PCR amplification, sublconed and sequenced. To combine human Vκ elements with rabbit spacers, human Vκ elements were amplified by PCR with primers (SEQ ID Nos 383-430, Table 2) using plasmid DNA as a template. Primers contained AscI or MluI sites.

Rabbit spacer sequences are amplified by PCR using primers SEQ ID NOs 431-450 (Table 2). BACs 179L1 and 215M22 are digested with SpeI, NheI, AclI, SfoI, MluI, and SalI/XhoI. Fragments are gel purified and used as amplification templates.

The spacer sequence located at the 5-end is amplified by an upstream oligonucleotide containing a FRT and an attB site. PCR products are gel purified using the GENECLEAN kit and subcloned into XL-PCR-TOPO™ (Invitrogen) according to the manufacturer's instructions.

Human Vk elements and rabbit spacer sequences were cloned into pGem (Promega) modified as described in Example 4.

Figure 7:
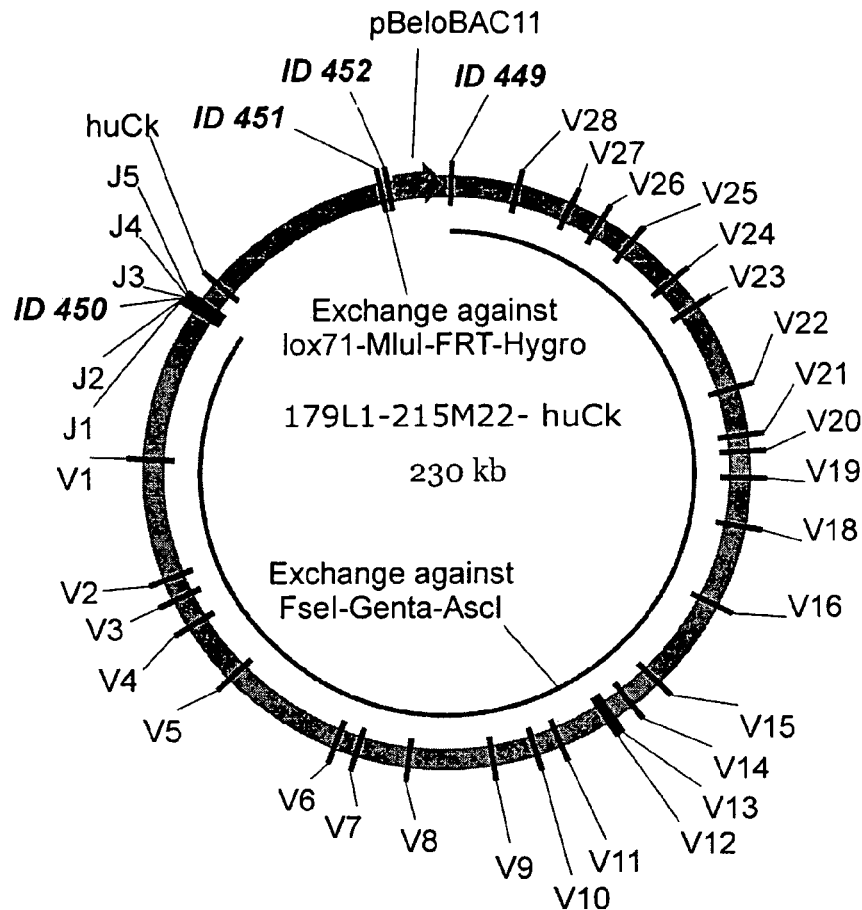
FIG. 7: Insertion of two cassettes by homologous recombination using the redεβγ-system. The upper cassette contains two restriction sites (FseI and AscI) flanking a gentamycin cassette. The lower cassette contains an inverted (i) and mutated (71) loxP-site, a FRT-site and a MluI-restriction site. After modification the BAC is digested with FseI and AscI.
Figure 7:
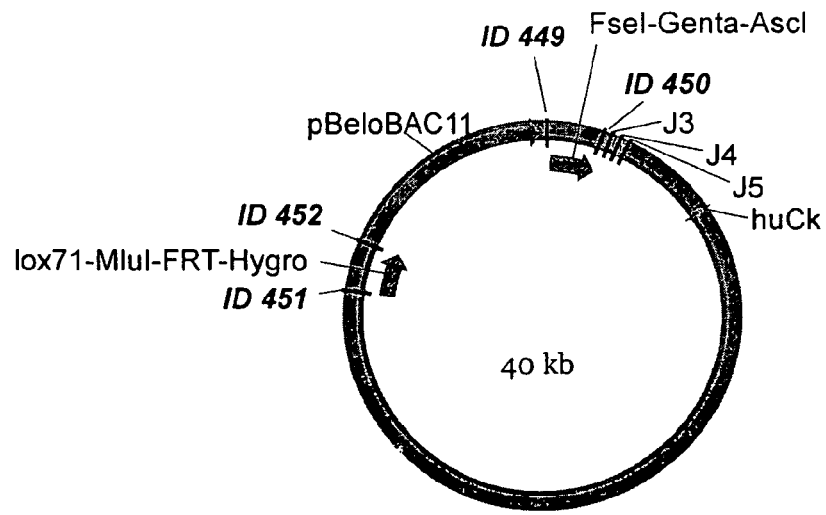

Human V kappa and the modified pGEM.genta vector are digested with AscI and MluI and ligated. Similarly, rabbit spacer sequences are cloned into pGEM.neo. Subsequently, pGem.neo. Vκ is cut with FseI and AscI and ligated with a purified insert of pGem.genta.spacer excised with FseI and MluI. Ligation of AscI and MluI complementary ends destroys the restriction enzyme site and allows repeated use of AscI and MluI for the construction of a Vκ locus comprising several Vκ and spacer elements. The final construct, consisting of fragments of a humanized BAC 179L1 and 215M22 and a humanized Vκ region is built in pBeloBAC. BAC 179L1 and 215M22 were modified and combined. Subsequently, BAC 179L1-215M22-huCk was further modified by ET cloning. Two cassettes containing restriction enzyme site, selection markers, and additional functional sites were inserted into the vector by ET-cloning as shown in FIG. 7. Primers (SEQ ID NOs 451-454) used for the amplification of the cassettes are listed in Table 2.

To built the final construct, units consisting of human V elements, rabbit spacer elements and a resistance marker are excised out of pGEM with FseI and MluI and ligated with BAC 179L1-215M22 digested with FseI and AscI. Subsequently, the resistance marker is replaced with a new insert consisting of human V elements, rabbit spacer elements and another resistance marker. After several repeats the final construct will consist of many Vk segments (L8, L4, A30, L11, L1, L5, L15, O8, L19, L12, A20, O4, L14, L23, L9, A4, L24, O6, L22, A9, A25, A15, O9) separated by rabbit spacer sequences. The humanized light chain locus is used for the generation of transgenic animals.

EXAMPLE 9

Construction of a Humanized Heavy Chain Locus with Chicken Heavy Chain Locus Spacer Sequences A synthetic humanized heavy chain locus containing a rabbit D region, a human J region, human Cµ, human Cγ, rabbit Cα4, the rabbit 3'α enhancer and human VH elements (including promotor and nonamer/heptamer sequences) separated by chicken spacer sequences is constructed.

Modified rabbit BAC 27N5 (see "Example 2) was further modified by ET cloning. The construct contained a humanized Cµ and Cγ and two unique restriction sites, BsiWI and AsiSI downstream of the α-4 membrane exon. DNA is amplified with oligonucleotides SEQ ID Nos 455 and 456 (Table 2).

Fosmid Fos15B is digested with NheI and the resulting 13 kb fragment contaning the 3' α enhancer is subcloned into a cloning vector in such a way that the insert is flanked by BsiWI and AsiSI sites. Subsequently, the insert is excised with BsiWI and AsiSI and ligated with the modified BAC 27N5 to form BAC 27N5Fos.

The rabbit J region in BAC219D23 was exchanged with the corresponding human J region by ET cloning. The human J region was amplified by PCR using primers SEQ ID NOs 457 and 458 (Table 2).

Unique restriction enzyme sites are inserted in BAC219D23 upstream of the D region (A) and upstream of Cµ(B). In BAC 27N5Fos restriction site A is inserted upstream of the linker region and B is inserted in sequences homologous to BAC219D23. Following digestion with enzymes A and B, the fragment containing human J and rabbit D regions is isolated and ligated with BAC 27N5Fos to create BAC 219D23/27N5Fos.

Chicken heavy chain spacer sequences are amplified from chicken genomic DNA by PCR using primers (SEQ ID NOS 459 and 460, Table 2) specific for chicken heavy chain V pseudogenes (Mansikka et al., *J Immunol* 145(11), 3601-3609 (1990), Reynaud et al., *Cell* 59(1), 171-183 (1989)). Alternatively, spacer sequences are synthesized chemically.

The PCR products are gel purified, cloned into pTOPO (Invitrogen) and sequenced.

Human heavy chain variable elements are amplified by PCR using primers designed according to published sequences in GENBANK (eg Acc. No. NG_001019) or synthesized chemically. The human V elements contain the human promoter region, the human leader sequence, the human intron between leader and V-coding region, the human V-coding region and the human recombination signal sequence. The amplified or synthesized fragments are flanked by specific restriction endonuclease recognition. Chicken spacer sequences and human V elements are combined in one or several large DNA fragment comprising a humanized immunoglobulin locus. The construct is used to generate transgenic animals.

EXAMPLE 10

Construction of a Humanized Immunoglobulin Locus Containing Human V Elements and Non-human Spacer Sequences (Without Promoter Region and RSS)

Figure 10:
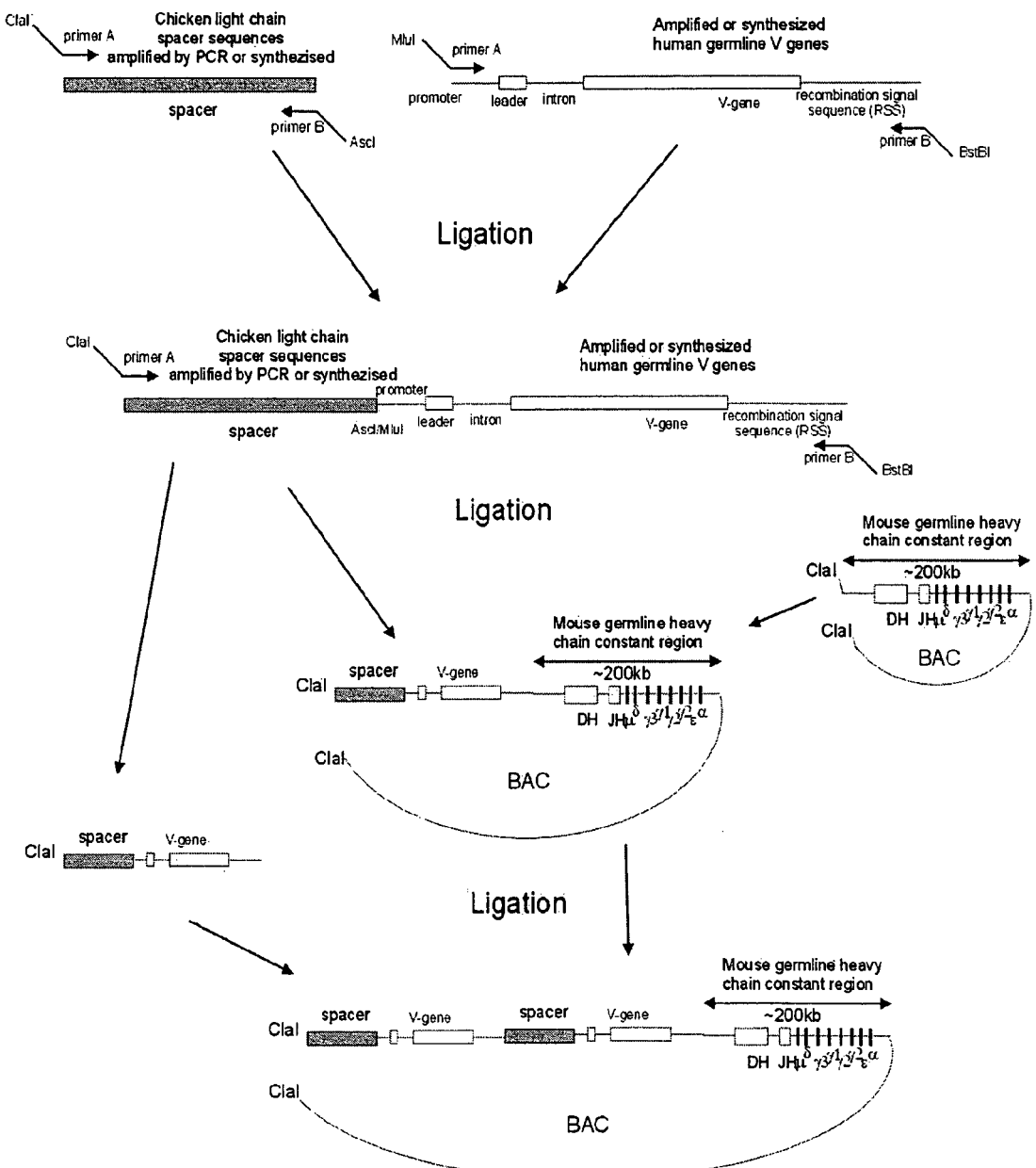
FIG. 10: An outline showing the construction of a humanized immunoglobulin locus using chicken immunoglobulin spacer sequences and human V elements.

A BAC library generated with non-human genomic DNA is screened with probes specific for immunoglobulin and BAC clones containing heavy and light chain immunoglobulin C, J and D regions are identified. The BAC clones are modified to contain restriction enzyme sites. Human heavy and light chain variable elements are amplified by PCR using primers designed according to published sequences in GenBank (eg., Acc. No. NG_001019). Sequences are amplified from genomic DNA or synthesized chemically. The human V elements contain the human promoter region, the human leader sequence, the human intron between leader and V-coding region, the human V-coding region and the human recombination signal sequence (RSS). The amplified or synthesized fragments have specific restriction endonuclease recognition sites at the ends. The non-human spacer sequences are amplified by PCR or synthesized chemically. Non-human spacer sequences and human V elements are combined in one or several large DNA fragment comprising a humanized immunoglobulin locus. The construct is used to generate transgenic animals. An example for the construction of a humanized V region using chicken spacer sequences is shown in FIG. 10.

EXAMPLE 11

Figure 11:
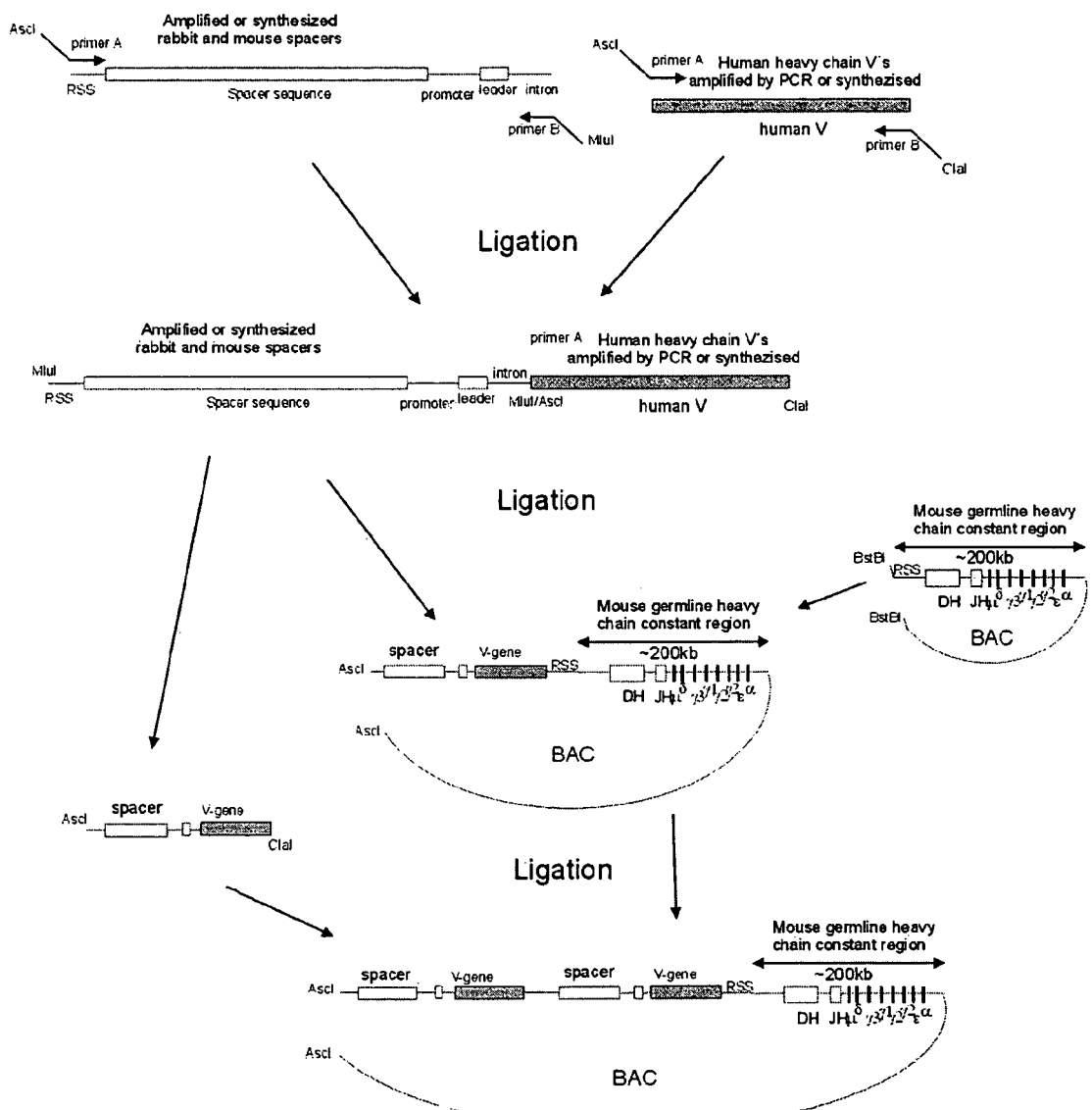
FIG. 11: An outline showing the construction of a humanized immunoglobulin locus using mouse or rabbit immunoglobulin spacer sequences and human V elements.

Construction of a Humanized Immunoglobulin Locus Containing Human V Elements and Non-human Spacer Sequences A BAC library generated with non-human genomic DNA is screened with probes specific for immunoglobulin and BAC clones containing heavy and light chain immunoglobulin C, J and D regions are identified. The BAC clones are modified to contain restriction enzyme sites. Human heavy and light chain variable elements are amplified by PCR using primers designed according to published sequences in GenBank (eg., Acc No. NG_001019). Sequences are amplified from genomic DNA or synthesized chemically. The human V elements contain the human V coding region. Non-human spacer sequences are amplified by PCR or synthesized chemically and contain a recombination signal sequence, a spacer sequence, a promotor region, a leader sequence and the intron between leader and V coding region. Such non-human spacer sequences are combined with human V elements in one or several large DNA fragments and used for the generation of transgenic animals. An example for the construction of a humanized V region using mouse or rabbit spacer sequences is shown in FIG. 11.

EXAMPLE 12

Transgenic Rabbits Expressing Humanized Immunoglobulins

Transgenic rabbits were generated as described by Fan et al. (*Pathol. Int.* 49: 583-594, 1999). Briefly, female rabbits are superovulated using standard methods and mated with male rabbits. Pronuclear-stage zygotes are collected from oviduct and placed in an appropriate medium such as Dulbecco's phosphate buffered saline supplemented with 20% fetal bovine serum. BAC containing humanized immunoglobulin loci were microinjected into the male pronucleus with the aid of a pair of manipulators. Morphological surviving zygotes were transferred to the oviducts of pseudopregnant rabbits. Pseudopregnancy was induced by the injection of human chorionic gonadotrophin (hCG). Following injection of a humanized light chain construct into 4645 pronuclei of fertilized oocytes, 4043 oocytes were transferred into 132 recipients. In total, 253 live offspring were born, 11 of which were transgenic. Expression of human kappa light chain was detected by ELISA using human-kappa light chain specific reagents (for example, mouse anti-human Kappa, Southern Biotech, 9220-01; goat anti-human Kappa, Southern Biotech 2063-08).

A humanized heavy chain construct was injected into 4083 pronuclei of fertilized oocytes. 3485 oocytes were transferred into 119 recipients which delivered 433 offspring. Analysis by PCR and FISH revealed that 20 of these animals were transgenic. Humanized heavy chain in the blood of founder animals was detected by ELISA using antibodies specific for human IgM/IgG (for example, rabbit anti-human IgM, Rockland 609-4131; rabbit anti-human IgM, Rockland 609-4631; rabbit anti-human IgG, Pierce 31142, rabbit anti-human IgG, Southern Biotech 6145-08; rabbit anti-human IgG, Pierce 31784).

Sandwich-type ELISAs detecting humanized κ, μ and γ chains were performed using standard procedures. Briefly, microtiter plates were coated with capture antibody and incubated with diluted serum samples. Bound human immunoglobulin was detected using a secondary labeled antibody and peroxidase-streptavidin-conjugate (Sigma, S2438).

Double transgenic animals expressing both humanized heavy and light immunoglobulin chains are generated by breeding of founder animals.

EXAMPLE 13

Transgenic Mice Expressing Humanized Immunoglobulins

Transgenic mive were generated as described by Nagy et al. (*Manipulating the Mouse Embryo: A Laboratory Manual*; Cold Spring Harbor Laboratory Press, New York, 2003). Briefly, female mice were superovulated using standard methods and mated with male mice. Pronuclear-stage zygotes were collected from oviduct and placed in a suitable medium such as M2 medium. BAC containing humanized immunoglobulin loci were microinjected into the male pronucleus with the aid of a pair of manipulators. Morphologically surviving zygotes were transferred to the oviducts of pseudopregnant female mice. Pseudopregnancy was induced by mating with sterile males. Following injection of a humanized light chain construct into 1325 pronuclei of fertilized oocytes, 787 oocytes were transferred into 29 recipients. In total, 55 live offspring were born, 11 of which were transgenic.

A humanized heavy chain construct was injected into 1050 pronuclei of fertilized oocytes. 650 oocytes were transferred into 25 recipients which delivered 64 live offspring. Analysis by PCR revealed that 19 of these animals were transgenic.

Double transgenic animals expressing both humanized heavy and light immunoglobulin chains are generated by breeding of founder animals. Expression of humanized κ, μ and γ chains was detected by ELISAs using standard procedures. Briefly, microtiter plates were coated with capture antibody and incubated with diluted serum samples. Bound human immunoglobulin was detected using a secondary labeled antibody and peroxidase-streptavidin-conjugate (Sigma, S2438).

All references cited throughout the specification are hereby expressly incorporated by reference. While the invention is illustrated by reference to certain embodiments, it is not so limited. One skilled in the art will recognize that various modifications and variations are possible without diverting from the essence of the invention. All such modifications and variations are specifically included within the scope herein.

TABLE 1

| ID | BAC | Accession# | Start | Finish | Description |
| --- | --- | --- | --- | --- | --- |
| 1 | 38A2 | AY386694 | 1 | 2137 | Spacer 5' start-V34 |
| 2 | 38A2 | AY386694 | 2433 | 9504 | Spacer V34-V33 |
| 3 | 38A2 | AY386694 | 9798 | 19384 | Spacer V33-V32 |
| 4 | 38A2 | AY386694 | 19690 | 35164 | Spacer V32-V31 |
| 5 | 38A2 | AY386694 | 35447 | 47669 | Spacer V31-V30 |
| 6 | 38A2 | AY386694 | 47973 | 52521 | Spacer V30-V29 |
| 7 | 38A2 | AY386694 | 52819 | 61798 | Spacer V29-V28 |
| 8 | 38A2 | AY386694 | 62100 | 74264 | Spacer V28-V27 |
| 9 | 38A2 | AY386694 | 74566 | 79145 | Spacer V27-V26 |
| 10 | 38A2 | AY386694 | 79449 | 84800 | Spacer V26-V25 |
| 11 | 38A2 | AY386694 | 85103 | 95717 | Spacer V25-V24 |
| 12 | 38A2 | AY386694 | 96009 | 102226 | Spacer V24-V26 |
| 13 | 38A2 | AY386694 | 102504 | 105307 | Spacer V23-V22 |
| 14 | 38A2 | AY386694 | 105603 | 107583 | Spacer V22-V24 |
| 15 | 38A2 | AY386694 | 107769 | 118033 | Spacer V24-V20 |
| 16 | 38A2 | AY386694 | 118334 | 125546 | Spacer V20-V19 |
| 17 | 38A2 | AY386694 | 125849 | 128059 | Spacer V19-3' end |
| 18 | 225P18 | AY386697 | 1 | 4333 | Spacer 5' start-V18 |
| 19 | 225P18 | AY386697 | 4629 | 9255 | Spacer V18-V17 |
| 20 | 225P18 | AY386697 | 9561 | 15841 | Spacer V17-V16 |
| 21 | 225P18 | AY386697 | 16135 | 22502 | Spacer V16-V15 |
| 22 | 225P18 | AY386697 | 22794 | 32821 | Spacer V15-V14 |
| 23 | 225P18 | AY386697 | 33118 | 37738 | Spacer V14-V13 |
| 24 | 225P18 | AY386697 | 38044 | 44571 | Spacer V13-V12 |
| 25 | 225P18 | AY386697 | 44865 | 49447 | Spacer V12-V11 |
| 26 | 225P18 | AY386697 | 49745 | 56909 | Spacer V11-V10 |
| 27 | 225P18 | AY386697 | 57205 | 63678 | Spacer V10-V9 |
| 28 | 225P18 | AY386697 | 63977 | 71204 | Spacer V9-V8 |
| 29 | 225P18 | AY386697 | 71507 | 76261 | Spacer V8-V7 |
| 30 | 225P18 | AY386697 | 76560 | 79012 | Spacer V7-V6 |
| 31 | 225P18 | AY386697 | 79308 | 83467 | Spacer V6-V5 |
| 32 | 225P18 | AY386697 | 83768 | 88013 | Spacer V5-V4 |
| 33 | 225P18 | AY386697 | 88314 | 91233 | Spacer V4-V3 |
| 34 | 225P18 | AY386697 | 91531 | 95929 | Spacer V3-V2 |
| 35 | 225P18 | AY386697 | 96233 | 100963 | Spacer V2-V1 |

TABLE 1-continued

| ID | BAC | Accession# | Start | Finish | Description |
|---|---|---|---|---|---|
| 36 | 225P18 | AY386697 | 101262 | 133721 | Spacer V1-D3 |
| 37 | 225P18 | AY386697 | 133752 | 135212 | Spacer D3-D1a |
| 38 | 225P18 | AY386697 | 135237 | 136922 | Spacer D1a-D4 |
| 39 | 225P18 | AY386697 | 136947 | 139446 | Spacer D4-3' end |
| 40 | 219D23 | AY386695 | 8151 | 40612 | Spacer V1-D3 |
| 41 | 219D23 | AY386695 | 40643 | 42102 | Spacer D3-D1a |
| 42 | 219D23 | AY386695 | 42127 | 43812 | Spacer D4-D1b |
| 43 | 219D23 | AY386695 | 43837 | 48553 | Spacer D1b-D6 |
| 44 | 219D23 | AY386695 | 48577 | 48753 | Spacer D6-D8 |
| 45 | 219D23 | AY386695 | 48769 | 51181 | Spacer D8-D2x |
| 46 | 219D23 | AY386695 | 51213 | 55826 | Spacer D1c-Df |
| 47 | 219D23 | AY386695 | 55852 | 61112 | Spacer Df-D1d |
| 48 | 219D23 | AY386695 | 61237 | 62445 | Spacer D1d-D5 |
| 49 | 219D23 | AY386695 | 62471 | 97024 | Spacer D5-DQ52 |
| 50 | 219D23 | AY386695 | 97036 | 97831 | Spacer DQ52-J1 |
| 51 | 219D23 | AY386695 | 97871 | 98090 | Spacer J1-J2 |
| 52 | 219D23 | AY386695 | 98140 | 98430 | Spacer J2-J3 |
| 53 | 219D23 | AY386695 | 98483 | 98642 | Spacer J3-J4 |
| 54 | 219D23 | AY386695 | 98690 | 98981 | Spacer J4-J5 |
| 55 | 219D23 | AY386695 | 99032 | 99550 | Spacer J5-J6 |
| 56 | 219D23 | AY386695 | 99604 | 106867 | Spacer J6-IgM exon1 |
| 57 | 219D23 | AY386695 | 107185 | 107290 | Spacer IgM exon1-exon2 |
| 58 | 219D23 | AY386695 | 107635 | 107863 | Spacer IgM exon2-exon3 |
| 59 | 219D23 | AY386695 | 108181 | 108268 | Spacer IgM exon3-exon4 |
| 60 | 219D23 | AY386695 | 108664 | 110499 | Spacer IgM exon4-exonM1 |
| 61 | 219D23 | AY386695 | 110615 | 110741 | Spacer exonM1-exonM2 |
| 62 | 219D23 | AY386695 | 108664 | 137302 | Spacer IgM exon4-3' end |
| 63 | 27N5 | AY386696 | 5099 | 55582 | Spacer IgM exon4-IgG exon1 |
| 64 | 27N5 | AY386696 | 55867 | 56071 | Spacer IgG exon1-exon2 |
| 65 | 27N5 | AY386696 | 56104 | 56201 | Spacer IgG exon2-exon3 |
| 66 | 27N5 | AY386696 | 56531 | 56623 | Spacer IgG exon3-exon4 |
| 67 | 27N5 | AY386696 | 56946 | 58984 | Spacer IgG exon4-exonM1 |
| 68 | 27N5 | AY386696 | 56946 | 59205 | Spacer IgG exon4-exonM2 |
| 69 | 27N5 | AY386696 | 56946 | 69246 | Spacer IgG exon4-IgE exon1 |
| 70 | 27N5 | AY386696 | 69546 | 69719 | Spacer IgE exon1-exon2 |
| 71 | 27N5 | AY386696 | 70037 | 70132 | Spacer IgE exon2-exon3 |
| 72 | 27N5 | AY386696 | 70453 | 70532 | Spacer IgE exon3-exon4 |
| 73 | 27N5 | AY386696 | 70873 | 73061 | Spacer IgE exon4-exonM1 |
| 74 | 27N5 | AY386696 | 70873 | 73292 | Spacer IgE exon4-exonM2 |
| 75 | 27N5 | AY386696 | 70873 | 86059 | Spacer IgE exon4-IgA4 exon1 |
| 76 | 27N5 | AY386696 | 86362 | 86498 | Spacer IgA4 exon1-exon2 |
| 77 | 27N5 | AY386696 | 86876 | 87059 | Spacer IgA4 exon2-exon3 |
| 78 | 27N5 | AY386696 | 87450 | 89577 | Spacer IgA4 exon3-exonM |
| 79 | 27N5 | AY386696 | 87450 | 103798 | Spacer IgA4 exon3-IgA5b exon1 |
| 80 | 27N5 | AY386696 | 104101 | 104231 | Spacer IgA5b exon1-exon2 |
| 81 | 27N5 | AY386696 | 104609 | 104787 | Spacer IgA5b exon2-exon3 |
| 82 | 27N5 | AY386696 | 105182 | 107227 | Spacer IgA5b exon3-exonM |
| 83 | 27N5 | AY386696 | 105182 | 112077 | Spacer IgA5b exon3-exonM |
| 84 | 27N5 | AY386696 | 105182 | 119223 | Spacer IgA5b exon3-IgA1 exon1 |
| 85 | 27N5 | AY386696 | 119511 | 119644 | Spacer IgA1 exon1-exon2 |
| 86 | 27N5 | AY386696 | 119984 | 120162 | Spacer IgA1 exon2-exon3 |
| 87 | 27N5 | AY386696 | 120557 | 122823 | Spacer IgA1 exon3-exonM |
| 88 | 27N5 | AY386696 | 120557 | 127750 | Spacer IgA1 exon3-exonM* |
| 89 | 27N5 | AY386696 | 120557 | 135838 | Spacer IgA1 exon3-IgA2 exon1 |
| 90 | 27N5 | AY386696 | 136138 | 136274 | Spacer IgA2 exon1-exon2 |
| 91 | 27N5 | AY386696 | 136652 | 136831 | Spacer IgA2 exon2-exon3 |
| 92 | 27N5 | AY386696 | 137229 | 139433 | Spacer IgA2 exon3-exonM |
| 93 | 27N5 | AY386696 | 137229 | 146676 | Spacer IgA2 exon3-3' end |
| 94 | Fos15B | AY386698 | 1 | 828 | Spacer 5' start-IgA exonM |
| 95 | Fos15B | AY386698 | 1043 | 3596 | Spacer IgA exonM-end contig1 |
| 96 | Fos15B | AY386698 | 1 | 3596 | Spacer 5' start-end contig 1 |
| 97 | Fos15B | AY386698 | 7404 | 7541 | Spacer IgA exon1-exon2 |
| 98 | Fos15B | AY386698 | 7908 | 8086 | Spacer IgA exon2-exon3 |
| 99 | Fos15B | AY386698 | 8481 | 10538 | Spacer IgA exon3-exonM |
| 100 | Fos15B | AY386698 | 8481 | 13140 | Spacer IgA exon3-end contig2 |
| 101 | Fos15B | AY386698 | 8481 | 15871 | Spacer IgA exon3-1, 2 hs 3' enh |
| 102 | Fos15B | AY386698 | 8481 | 21447 | Spacer IgA exon3-4hs enh |
| 103 | Fos15B | AY386698 | 21484 | 33297 | Spacer 4hs enh-end contig4 |
| 104 | Fos15B | AY386698 | 16633 | 33297 | Spacer 1, 2hs 3' enh-end contig4 |
| 105 | 179L1 | AY495827 | 1 | 124285 | Spacer 5' end-enh |
| 106 | 179L1 | AY495827 | 125411 | 131350 | Enhancer-C□ |
| 107 | 179L1 | AY495827 | 131664 | 134637 | Spacer C□-J5 |
| 108 | 179L1 | AY495827 | 134684 | 134915 | Spacer J5-J4 |
| 109 | 179L1 | AY495827 | 134952 | 135196 | Spacer J4-J3 |
| 110 | 179L1 | AY495827 | 135241 | 135485 | Spacer J3-J2 |
| 111 | 179L1 | AY495827 | 135525 | 135863 | Spacer J2-J1 |
| 112 | 179L1 | AY495827 | 135897 | 155257 | Spacer J1-V1 |

TABLE 1-continued

| ID | BAC | Accession# | Start | Finish | Description |
|---|---|---|---|---|---|
| 113 | 179L1 | AY495827 | 155572 | 170621 | Spacer V1-V2 |
| 114 | 179L1 | AY495827 | 170936 | 173443 | Spacer V2-V3 |
| 115 | 179L1 | AY495827 | 173752 | 177227 | Spacer V3-V4 |
| 116 | 179L1 | AY495827 | 177536 | 185356 | Spacer V4-V5 |
| 117 | 179L1 | AY495827 | 185664 | 200758 | Spacer V5-V6 |
| 118 | 179L1 | AY495827 | 201064 | 203580 | Spacer V6-V7 |
| 119 | 179L1 | AY495827 | 203886 | 205144 | Spacer V7-3' end |
| 120 | 215M22 | AY495826 | 1 | 12829 | Spacer 5' end-V6 |
| 121 | 215M22 | AY495826 | 13136 | 15653 | Spacer V6-V7 |
| 122 | 215M22 | AY495826 | 15957 | 22241 | Spacer V7-V8 |
| 123 | 215M22 | AY495826 | 22551 | 32876 | Spacer V8-V9 |
| 124 | 215M22 | AY495826 | 33188 | 38276 | Spacer V9-V10 |
| 125 | 215M22 | AY495826 | 38582 | 41476 | Spacer V10-V11 |
| 126 | 215M22 | AY495826 | 41780 | 47827 | Spacer V11-V12 |
| 127 | 215M22 | AY495826 | 48133 | 48547 | Spacer V12-V13 |
| 128 | 215M22 | AY495826 | 48841 | 51408 | Spacer V13-V14 |
| 129 | 215M22 | AY495826 | 51638 | 55438 | Spacer V14-V15 |
| 130 | 215M22 | AY495826 | 55745 | 67437 | Spacer V15-V16 |
| 131 | 215M22 | AY495826 | 67743 | 77805 | Spacer V16-V17 |
| 132 | 215M22 | AY495826 | 78120 | 80628 | Spacer V17-V18 |
| 133 | 215M22 | AY495826 | 80937 | 84009 | Spacer V18-V19 |
| 134 | 215M22 | AY495826 | 84315 | 87339 | Spacer V19-V20 |
| 135 | 215M22 | AY495826 | 87648 | 89399 | Spacer V20-V21 |
| 136 | 215M22 | AY495826 | 89711 | 95414 | Spacer V21-V22 |
| 137 | 215M22 | AY495826 | 95720 | 106650 | Spacer V22-V23 |
| 138 | 215M22 | AY495826 | 106956 | 110940 | Spacer V23-V24 |
| 139 | 215M22 | AY495826 | 111246 | 117877 | Spacer V24-V25 |
| 140 | 215M22 | AY495826 | 118183 | 122396 | Spacer V25-V26 |
| 141 | 215M22 | AY495826 | 122706 | 126496 | Spacer V26-V27 |
| 142 | 215M22 | AY495826 | 126802 | 133358 | Spacer V27-V28 |
| 143 | 19O2 | AY495828 | 37134 | 48826 | Spacer V15-V16 |
| 144 | 19O2 | AY495828 | 49032 | 59195 | Spacer V16-V17 |
| 145 | 19O2 | AY495828 | 115057 | 125885 | Spacer V28-V29 |
| 146 | 19O2 | AY495828 | 126195 | 130012 | Spacer V29-V30 |
| 147 | 19O2 | AY495828 | 130318 | 136966 | Spacer V30-V31 |
| 148 | 19O2 | AY495828 | 137272 | 144512 | Spacer V31-V32 |
| 149 | 19O2 | AY495828 | 144819 | 148617 | Spacer V32-V33 |
| 150 | 19O2 | AY495828 | 148923 | 155402 | Spacer V33-V34 |
| 151 | 19O2 | AY495828 | 155714 | 171415 | Spacer V34-V35 |
| 152 | 19O2 | AY495828 | 171572 | 177676 | Spacer V35-V36 |
| 153 | 19O2 | AY495828 | 177979 | 178083 | Spacer V36-3' end |
| 154 | CLC* | NA | 1 | 443 | Spacer 5' end-pV28** |
| 155 | CLC* | NA | 486 | 1203 | Spacer pV28-PV27** |
| 156 | CLC* | NA | 1528 | 1635 | Spacer pV27-pV26** |
| 157 | CLC* | NA | 1818 | 2242 | Spacer pV26-pV25** |
| 158 | CLC* | NA | 2585 | 2676 | Spacer pV25-pV24** |
| 159 | CLC* | NA | 2781 | 3327 | Spacer pV24-pV23** |
| 160 | CLC* | NA | 3464 | 3659 | Spacer pV23-pV22** |
| 161 | CLC* | NA | 3985 | 4241 | Spacer pV22-pV21** |
| 162 | CLC* | NA | 4578 | 4994 | Spacer pV21-pV20** |
| 163 | CLC* | NA | 5366 | 5425 | Spacer pV20-pV19** |
| 164 | CLC* | NA | 5749 | 5842 | Spacer pV19-pV18** |
| 165 | CLC* | NA | 6034 | 7043 | Spacer pV18-pV17** |
| 166 | CLC* | NA | 7266 | 7493 | Spacer pV17-pV16** |
| 167 | CLC* | NA | 7625 | 7625 | Spacer pV16-pV15** |
| 168 | CLC* | NA | 7988 | 8758 | Spacer pV15-pV14** |
| 169 | CLC* | NA | 9100 | 9410 | Spacer pV14-pV13** |
| 170 | CLC* | NA | 9787 | 10057 | Spacer pV13-pV12** |
| 171 | CLC* | NA | 10441 | 11022 | Spacer pV12-pV11** |
| 172 | CLC* | NA | 11380 | 11911 | Spacer pV11-pV10** |
| 173 | CLC* | NA | 12162 | 12349 | Spacer pV10-pV9** |
| 174 | CLC* | NA | 12691 | 13357 | Spacer pV9-pV8** |
| 175 | CLC* | NA | 13708 | 13882 | Spacer pV8-pV7** |
| 176 | CLC* | NA | 14229 | 14406 | Spacer pV7-pV6** |
| 177 | CLC* | NA | 14599 | 15338 | Spacer pV6-pV5** |
| 178 | CLC* | NA | 15613 | 16578 | Spacer pV5-pV4** |
| 179 | CLC* | NA | 16916 | 18219 | Spacer pV4-pV3** |
| 180 | CLC* | NA | 18439 | 18879 | Spacer pV3-pV2** |
| 181 | CLC* | NA | 19248 | 19343 | Spacer pV2-pV1** |
| 182 | CLC* | NA | 19609 | 22208 | Spacer pV1-V** |
| 183 | CLC* | NA | 22506 | 24313 | Spacer V-J |
| 184 | CLC* | NA | 24350 | 26088 | Spacer J-C☐ |
| 185 | CLC* | NA | 26402 | 36259 | Spacer C-3' end |

*CLC - Chicken light chain locus SEQ ID 184, FIG. 9
**pV - pseudo V gene (not functional)

Comments:
BAC sequences submitted to GenBank were modified by deletion of vector sequences at the 5' and 3' end as follows:

| BAC | Accession# | Removed from 5' end | Removed from 3' end |
|---|---|---|---|
| 38A2 | AY386694 | 1-125 | 1281285-128225 |
| 219D23 | AY386695 | 1-54 | 137357-137389 |
| Fos15B* | AY3866968 | 1-97 | 33395-33427 |

-continued

| BAC | Accession# | Removed from 5' end | Removed from 3'end |
|---|---|---|---|
| 179L1 | AY495827 | 0 | 205145-205968 |
| 196O2 | AY495828 | 1-32 | 178117-178171 |

*In addition contigs in GenBank are separated by 50 nt. In the Fos15B sequence submitted with the provisional application contigs were separated by 10 nt.

TABLE 2

| ID | Region | Sequence |
|---|---|---|
| 193 | $V_H1$ | 5'CGCGGATCCGAGACTGGGCTGCGCTG3' |
| 194 | $V_H1$ | 5'CGCAAGCTTGAAATAGGTGGCCGTGTC3' |
| 195 | $J_H$ | 5'CGCGGATCCAGGCACCCTGGTCACCG3' |
| 196 | $J_H$ | 5'CGCAAGCTTGTGACCAGGGTGCCCTG3' |
| 197 | Cγ | 5'CGCGGATCCCTGGAGCCGAAGGTCTAC3' |
| 198 | Cγ | 5'CGCAAGCTTGAGATGGACTTCTGCGTG3' |
| 199 | 3'Enh | 5'CGCGGATCCCAGAGTGGGTCTGTGACA3' |
| 200 | 3'Enh | 5'CGCAAGCTTACAGGCGCATGCAAATGC3' |
| 201 | Vκ | 5'CGCGGATCCGAGGCACAGTCACCATC3' |
| 202 | Vκ | 5'CGCAAGCTTACAGTAGTAAGTGGCAGC3' |
| 203 | Jκ | 5'CGCGGATCCGGAGGGACCGAGGTGGT3' |
| 204 | Jκ | 5'CGCAAGCTTACCATGGTCCCTGAGCC3' |
| 205 | C☐ | 5'CGCGGATCCCCTCAGGTGATCCAGTTG3' |
| 206 | C☐ | 5'CGCAAGCTTCTATTGAAGCTCTGGACG3' |
| 207 | K 3'Enh | 5'CGCGGATCCGTGACTGGCCCAAGAAG3' |
| 208 | K 3'Enh | 5'CGCAAGCTTATACAACCTTGGCCAGG3' |
| 209 | C☐ | 5'AAACAGCTTTTCACACCTCCCCTTTCTCTCTTTGCTCCCC TGGGCCCTCAGGGAGTGCATCCGCCCCAACCCTTTTCC3' |
| 210 | C☐ | 5'CAGGGTTAGTTTGCATIGCACACACACACAGCGCCTGGTC ACCCAGAGGGGTCAGTAGCAGGTGCCAGCTGTGTCGGACATG3' |
| 211 | C☐ | 5'GGTCAGGGGTCCTCCAGGGCAGGGGTCACATTGTGCCCC TTCTCTTGCAGCCTCCACCAAGGGCCCATCGGTC3' |
| 212 | Cγγ | 5'CACAGCTGCGGCGTGGGGGGAGGGAGAGGGCAGCTCG CCGGCACAGCGCTCATTTACCCGGAGACAGGGAGAGGCTCTTC3' |
| 213 | $J_H$ | 5'GTGTTATAAAGGGAGACTGAGGGGGCAGAGGCTGTGCTA CTGGTACCTGGCTGAATACTTCCAGCACTGGGGCCAGG3' |
| 214 | $J_H$ | 5'GGCCACAGAAAAGAGGAGAGAATGAAGGCCCCGGAGAG GCCGTTCCTACCTGAGGAGACGGTGACCGTGGTCCCTTG-3' |
| 215 | Genta | 5'CCAGGCCGGCCTGGAGTTGTAGATCCTCTACG3' |
| 216 | Genta | 5'CCAGGCGCGCCAAGATGCGTGATCTGATCC3' |
| 217 | Linker | 5'GGCCGCGGCCGGCCATCGATGGCGCGCCTTCGAAACGCGTA3' |
| 218 | Linker | 5'AGCTTACGCGTTTCGAAGGCGCGCCATCGATGGCCGGCCGC3' |
| 219 | pBB11.1 | 5'ATTCCCAAGCTTTTAATTAAGACGTCAGCTTCCTTAGCTCCTG3' |
| 220 | pBB11.1 | 5'ATTCGCGGATCCACGCGTTTCGTTCCCAAAGGCGCGCCTAGCG ATGAGCTCGGAC3' |

TABLE 2-continued

| ID | Region | Sequence |
|---|---|---|
| 221 | Neo | 5'GCAGGCATGCAAAGCTTATTACACCAGTGTCAGTAAGCG3' |
| 222 | Neo | 5'GGTACCCGGGGATCCTCAGAAGAACTCGTCAAGAAGGCG3' |
| 223 | pBB11.2 | 5'AAATTCCCTTAATTAAGACGTCAGCTTCCTTAGCTCCTG3' |
| 224 | pBB11.2 | 5'GAAACCGGGGACGCGTTACCGTTCGTATAATGTATGCTATACGAAGTTATGCGGCCGCTAGCGATGAGCTCGGAC3' |
| 225 | CA | 5'TTCTCTGTTTTTGTCCGTGGAATGAACAATGGAAGTCCGAGCTCATCGCTAAGGGCACCAATAACTGC3' |
| 226 | CA | 5'CACAGGAGAGAAACAGGACCTAGAGGATGAGGAAGTCCCTGTAGGCTTCCTACCGTTCGTATAATGTATGCTATACGAAGTTATTACCTGTGACGGAAGATC-3' |
| 227 | $V_H3$-9 | 5'ATAGAGAGATTGAGTGTG3' |
| 228 | $V_H3$-9 | 5'TCCTGTCTTCCTGCAG3' |
| 229 | $V_H3$-11 | 5'AGAGACATTGAGTGGAC3' |
| 230 | $V_H3$-11 | 5'AGGGAGGTTTGTGTC3' |
| 231 | $V_H3$-13 | 5'ACTAGAGATATTGAGTGTG3' |
| 232 | $V_H3$-13 | 5'AGGCATTCTGCAGGG3' |
| 233 | $V_H3$-15 | 5'ACTAGAGAGATTAAGTGTG3' |
| 234 | $V_H3$-15 | 5'TCACACTGACCTCCC3' |
| 235 | $V_H3$-20 | 5'TCATGGATCAATAGAGATG3' |
| 236 | $V_H3$-20 | 5'TGCAGGGACGTTTGTG3' |
| 237 | $V_H3$-23 | 5'AGAAAAATTGAGTGTGAA3' |
| 238 | $V_H3$-23 | 5'GTGTCTGGGCTCACAA3' |
| 239 | $V_H3$-30 | 5'AGAGAGACTGAGTGTG3' |
| 240 | $V_H3$-30 | 5'TGCAGGGAGGTTTGTG3' |
| 241 | $V_H3$-43 | 5'TGAGTGTGAGTGAACATG3' |
| 242 | $V_H3$-43 | 5'ACCAGCTCTTAACCTTC3' |
| 243 | $V_H3$-64 | 5'TGAGTGTGAGTGGAC3' |
| 244 | $V_H3$-64 | 5'TGACGCTGATCAGTG3' |
| 245 | $V_H3$-66 | 5'TCTGACCAATGTCTCTG3' |
| 246 | $V_H3$-66 | 5'AGGTTTGTGTCTGGGC3' |
| 247 | $V_H3$-72 | 5'ACAAGGTGATTTATGGAG3' |
| 248 | $V_H3$-72 | 5'AGGTTTGTGTCCGGG3' |
| 249 | $V_H3$-9 | 5'TTGGCGCGCC TGTCGTCTGTGTTTGCAG GTGTCC3' |
| 250 | $V_H3$-9 | 5'TTGCACGCGTGCAGGGAGGTTTGTGTCTGGGCTCAGCCTGAGGGCCCCTCACTGTGTCATCTTTTGCAC3' |
| 251 | $V_H3$-11 | 5'TTGGCGCGCC TGTCGTCTGTGTTTGCAG GTGTCC3 |
| 252 | $V_H3$-11 | 5'TTGCACGCGTGCAGGGAGGTTTGTGTCTGGGCTCAGCCTGAGGGCCCCTCACTGTGTCTCTCG3' |
| 253 | $V_H3$-13 | 5'TTGGCGCGCCTGTCGTCTGTGTTTGCAGGTGTCC3' |
| 254 | $V_H3$-13 | 5'TTGCACGCGTGCAGGGAGGTTTGTGTCTGGGCTCAGCCTGAGGGCCCCTCACTGTGTCTCTTG3' |
| 255 | $V_H3$-15 | 5'TTGGCGCGCCTGTCGTCTGTGTTTGCAGGTGTCC3' |

TABLE 2-continued

| ID | Region | Sequence |
|---|---|---|
| 256 | V$_H$3-15 | 5'TTGCACGCGTGCAGGGAGGTTTGTGTCTGGGCTCAGCCTGAGGGCCCCTCACTGTGTCTGTGG3' |
| 257 | V$_H$3-20 | 5'TTGGCGCGCC TGTCGTCTGTGTTTGCAGGTGTC3' |
| 258 | V$_H$3-20 | 5'TTGCACGCGTGCAGGGAGGTTTGTGTCTGGGCTCAGCCTGAGGGCCCCTCACTGTGTCTCTC3' |
| 259 | V$_H$3-23 | 5'TTGGCGCGCCTGTCGTCTGTGTTTGCAG GTGTCCAGTGTG3' |
| 260 | V$_H$3-23 | 5TTGCACGCGTGCAGGGAGGTTTGTGTCTGGGCTCAGCCTGAGGGCCCCTCACTGTGTCTTTC3' |
| 261 | V$_H$3-30 | 5'TTGGCGCGCCTGTCGTCTGTGTTTGCAGGTGTCCAGTGTC3' |
| 262 | V$_H$3-30 | 5'TTGCACGCGTGCAGGGAGGTTTGTGTCTGGGCTCAGCCTGAGGGCCCCTCACTGTGTCTTTCG3' |
| 263 | V$_H$3-43 | 5'TTGGCGCGCCTGTCGTCTGTGTTTGCAGGTGTCC3' |
| 264 | V$_H$3-43 | 5'TTTGCACGCGTGCAGGGAGGTTTGTGTCTGGGCTCAGCCTGAGGGCCCCTCACTGTGTCTCTTTTGCAC3' |
| 265 | V$_H$3-64 | 5'TTGGCGCGCCTGTCGTCTGTGTTTGCAGGTGTCC3' |
| 266 | V$_H$3-64 | 5'TTGCACGCGTGCAGGGAGGTTTGTGTCTGGGCTCAGCCTGAGGGCCCCTCACTGTGTCTCTCGCAC3' |
| 267 | V$_H$3-66 | 5'TTGGCGCGCCTGTCGTCTGTGTTTGCAGGTGTCC3' |
| 268 | V$_H$3-66 | 5'TTGCACGCGTGCAGGGAGGTTTGTGTCTGGGCTCAGCCTGAGGGCCCCTCACTGTGTCTCCG3' |
| 269 | V$_H$3-72 | 5'TTGGCGCGCCTGTCGTCTGTGTTTGCAG GTTTCC3' |
| 270 | V$_H$3-72 | 5'TTGCACGCGTGCAGGGAGGTTTGTGTCTGGGCTCAGCCTGAGGGCCCCTCACTGTGTCTCTAGCAC3' |
| 271 | V1-2 | 5'TTGGCGCGCCAGGGGAGTGCGGCTCCAC3' |
| 272 | V1-2 | 5'TTGCACGCGT TGGTCAGGACACTGTCACTCAC3' |
| 273 | V2-3 | 5'TTGGCGCGCCAGGGGCGCGCGGCTCCAC3' |
| 274 | V2-3 | 5'TTGCACGCGTTGATCACGAAACTGTCACTCACACTCTC3' |
| 275 | V3-4 | 5'TTGGCGCGCCAGGGGCGCGCGGCTCCAC3' |
| 276 | V3-4 | 5'TTGCACGCGTTCTGTTGGTCTCTTCTTCTCTTGCTATAAC3' |
| 277 | V4-5 | 5'TTGGCGCGCCAGGGGAGTGCGGCTCCAC3' |
| 278 | V4-5 | 5'TTGCACGCGTTGGTCAAGACACTGTCACTCAC3 |
| 279 | V5-6 | 5'TTGGCGCGCCAGGGACGCACGGCTCCAC3' |
| 280 | V5-6 | 5'TTGCACGCGTTGGTCAGGAAGCTGTCACTCAC3' |
| 281 | V6-7 | 5'TTGGCGCGCCAGGGATGCGCGGCTCCAG3' |
| 282 | V6-7 | 5'TTGCACGCGTTGGTCAGGACACTGTCACTGACAC3' |
| 283 | V7-8 | 5'TT GGCGCGCCAGGGGAGTGCGGCTCCAC3' |
| 284 | V7-8 | 5'TTGCACGCGTTGGTCAGGAAGCTGTCACTCACTCTC3' |
| 285 | V21-22 | 5'TT GGCGCGCCGGGGCCCGCGGCTCCAC3' |
| 286 | V21-22 | 5'TTGCACGCGTTGGTCAGGAAGCTGTCAC3' |
| 287 | V22-23 | 5'TTGGCGCGCCAGGGACGTGAGGCTCTAC3' |
| 288 | V22-23 | 5'TTGCACGCGTTGGTCAGGGCACTGTCAC3' |
| 289 | Linker | 5'GGCCGCGGCCGGCCATCGATGGCGCGCC TTCGAAACGCGTA3' |

TABLE 2-continued

| ID | Region | Sequence |
|---|---|---|
| 290 | Linker | 3'CGCCGGCCGGTAGCTACCGCGCGGAAGCTT TGCGCATTCGA5' |
| 291 | Linker | 5'CGG CCG GCC ATC GAT GGC GCG CCT TCG AAA CGC GTG GTA C3' |
| 292 | Linker | 3'TCG AGC CGG CCG GTA GCT ACC GCG CGG AAG CTT TGC GCA Cs, |
| 293 | Genta | 5'CCAGGCCGGCCTGGAGTTGTAGATCCTCTACG3' |
| 294 | Genta | 5'CCAGGCGCGCCAAGATGCGTGATCTGATCC-3' |
| 295 | Neo | 5'CCAGGCCGGCCATTACACCAGTGTCAGTAAGCG3' |
| 296 | Neo | 5'CCAGGCGCGCCTCAGAAGAACTCGTCAAGAAGGCG3' |
| 297 | Linker | 5'GAT CCG GCC GGC CAT CGA TGG CGC GCC TTC GAA ACG CGT TAG GGA TAA CAG GGI AAT A3' |
| 298 | Linker | 3'GCC GGC CGG TAG CTA CCG CGC GGA AGC TTT GCG CAA TCC CTA TTG TC CCA TTA TCGA5' |
| 299 | Neo | 5'ATCTGCACTCAGTGCGTCTTGAGCGCCCCCTGGTAGAGCCG CGCGACCCT GGCGCGCC ATTACACCAGTGTCAGTAAGCG 3' |
| 300 | Neo | 5'AAATGACCAGTCTGACAGCCGCGGACACGGCCACCTATTTC TGTGCGAGA GGCCGGCC TCAGAAGAACTCGTCAAGAAGGCG3' |
| 301 | Cκ Km3 | 5'GATGTCCACTGGTACCTAAGCCTCGCCCTCTGTGCTTCTTCCCTC CTCAGGAACTGTGGCTGCACCATCTGTCTTC3' |
| 302 | Cκ Km3 | 5'GAGGCTGGGCCTCAGGGTCGCTGGCGGTGCCCTGGCAGGCGTC TCGCTCTAACACTCTCCCCTGTTGAAGCTCTTTGTG3 |
| 303 | Neo | 5'CTTTCTCTGTCCTTCCTGTGCGACGGTTACGCCGCTCCATGAGCTT ATCGTAACTATAACGGTCCTAAGGTAGCGATGGACAGCAAGCGAA CCGGA3' |
| 304 | Neo | 5'GGACCAGTTTACAATCCCACCTGCCATCTAAGAAAGCTGGTCTCA TCGTGTCAGAAGAACTCGTCAAGAAG3' |
| 305 | Zeo | 5'CCCCCCCCGCCACTTCTCTTCTGTTTCGTTTAAGTTCTACACTGAC ATACTAGGGATAACAGGGTAATAACGTTTACAATTTCGCCTGATG3 |
| 306 | Zeo | 5'AGTGGGTAGGCCTCGCGGCCGCCTGGCCGTCGACATTTAGGTGA CACTATAGAAGGATCCTAGCACGTGTCAGTCCTGCT3' |
| 307 | Genta | 5'TTACGCCAAGCTATTTAGGTGACACTATAGAATACTCAAGCTTTG ATTGCTAACTATAACGGTCCTAAGGTAGCGATGAAGGCACGAACCC AGTTG3' |
| 308 | Genta | 5'GCGGAATTCTATGTCTAGTGGAGGGTGAAGCTGGTGATTATAGA GTGAAAATTACCCTGTTATCCCTATCGGCTTGAACGAATTGTTAG3' |
| 309 | VJ | 5'CATAAATATACTGTCTTCCAGGATCTTAGAGCTCACCTAAGGAAA CAAGAGTTCATTTGAAGTTTTTAAAGTG3' |
| 310 | VJ | 5'ACTCCAGAAGTTCCTATACTTTCTAGAGAATAGGAACTTCGGAAT AGGAACTTCCTTTGATCTCCACCTTGGTC3' |
| 311 | Genta | 5'GAAGTTCCTATTCCGAAGTTCCTATTCTCTAGAAAGTATAGGAAC TTCTGGAGTTGTAGATCCTCTACG3' |
| 312 | Genta | 5'AAAACAAACCAATCAGGCAGAAACGGTGAGGAATCAGTGAAAC GGCCACTTACGAAGTTCCTATACTTTCTAGAGAATAGGAACTTCGG AATAGGAACTTCAAGATGCGTGATCTGATCC3' |
| 313 | FRT | 5'TTATGCTGCATCCAGTTTGC3' |
| 314 | FRT | 5'AAAACAAACCAATCAGGCAG3' |
| 315 | FRT | 5'TGTGACATCCAGATGAC3' |
| 316 | FRT | 5'AAAACAAACCAATCAGGCAG3' |

TABLE 2-continued

| ID | Region | Sequence |
|---|---|---|
| 317 | Genta | 5'GGACCAGTTTACAATCCCACCTGCCATCTAAGAAAGCTGGTCTCATCGTGGTGCCAGGGCGTGCCCTTGGGCTGGGGCGCGATAACTTCGTATAGCATACATTATACGAAGTTATCGATCGTGGAGTTGTAGATCCTCTACG3' |
| 318 | Genta | 5'TTACGCCAAGCTATTTAGGTGACACTATAGAATACTCAAGCTTTGATTGCAAGATGCGTGATCTGATCCT3' |
| 319 | Linker | 5'CGGGATCCGCGCGTACGGAAGTTCCTATACCTTTTGAAGAATAGGAACTTCGGAATAGGAACTTCATTACACCAGTGTCAGTAAGCG3' |
| 320 | Linker | 5'GGGAAGCTTCGCGCGATCGCCGCTTTCGCAAAGGCGCGCCTCAGAAGAACTCGTCAAGAAGGCG3' |
| 321 | Genta | 5'GGCGGCCGCCTGGCCGTCGACATTTAGGTGACACTATAGAAGGATCCGCGTGGAGTTGTAGATCCTCTACG3' |
| 322 | Genta | 5'AACTCAGTAAGGAAAAGGACTGGGAAAGTGCACTTACATTTGATCTCCAGGCGCGCCAAGATGCGTGATCTGATCC3' |
| 323 | Neo | 5'GGACCAGTTTACAATCCCACCTGCCATCTAAGAAAGCTGGTCTCATCGTGGTGCCAGGGCGTGCCCTTGGGCTGGGGCGCGGAAGTTCCTATTCCGAAGTTCCTATTCTTCAAAAGGTATAGGAACTTCCGTACGATTACACCAGTGTCAGTAAGCG3' |
| 324 | Neo | 5'GGACTGATGGGAAAATAGAGGAGAAAATTGACCAGAGGAAGTGCAGATGGTCAGAAGAACTCGTCAAGAAGGCG3' |
| 325 | RSS | 5'AACCTGAAGATTTTGCAACTTACTACTGTCAACAGAGTTACAGTACCCCTTCCACAGTGATACAAGCCC3' |
| 326 | RSS | 5'TGCCGGCCACGATGCGTCCGGCGTAGAGGATCTACAACTCCAGGCGCGCCTGGTCATGTCAGTGCTGCTGC3' |
| 327 | Genta | 5'CTCCTTTCCTCCTCCTTGGTGGCAGCAGCACTGACATGACCAGGCGCGCC TGGAGTTGTAGATCCTCTACG 3' |
| 328 | Genta | 5'TGTAATACGACTCACTATAGGGCGAATTCGAGCTCGGTACCCGGGGATCCCGTACGAAGATGCGTGATCTGATCC3' |
| 329 | Kana | 5'GGCGGCCGCCTGGCCGTCGACATTTAGGTGACACTATAGAAGGATCCGCGACCCTGTTATCCCTAGATTTAAATGATATCGG 3' |
| 330 | Kana | 5'AACTTTCTCCTACAGATCCCAGATAACCATGAATTTATTCACCATCTTGGGCGCGCCGAAGTTCCTATACTTTCTAGAGAATAGGAACTTCGGAATAGGAACTTCAGTTGGTGATTTTGAACTTTTGCTTTGCC3' |
| 331 | Amp | 5'GGACCAGTTTACAATCCCACCTGCCATCTAAGAAAGCTGGTCTCATCGTGGTGCCAGGGCGTGCCCTTGGGCTGGGGCGCGGCGATCGCGAAGTTCCTATTCCGAAGTTCCTATTCTTCAAAAGGTATAGGAACTTCTACGGGGTCTGACGCTCAG 3' |
| 332 | Amp | 5'GAATTCAGAGCTCAATGAGTTGCCTTGTTCAGAGCTCTATTTTCACTTGACGTACGACAGACAAGCTGTGACCGTC3' |
| 333 | J Region | 5'GAGTTAGGCCTCAGAGCTGAGGCAGGGCTCGGTTCCCCTTGGGTGAGAAGGGTTTCTGTTCAGCAAGAC3' |
| 334 | J Region | 5'TGGCCAATTAGAGCAAAATTTCAGACAGTAATAGGAAAAGGTACTTACGTTTAATCTCCAGTCGTGTC3' |
| 335 | O2 | 5'TCAGTACTGACTGGAAC3' |
| 336 | O2 | 5'CCAATGACTTTCAAAACC3' |
| 337 | L8 | 5'CCGTACAGCCTGGCTC3' |
| 338 | L8 | 5'AACACCATCAGAGTGTGC |
| 339 | L4 | 5'ATGATTAATTGTGTGGACC3' |
| 340 | L4 | 5'AGGTGATCTCATATCCTC3' |
| 341 | A30 | 5'CTCAGTACTGCTTTACTG3' |
| 342 | A30 | 5'TGACTTCATGTCCCCTTC3' |

TABLE 2-continued

| ID | Region | Sequence |
|---|---|---|
| 343 | L11 | 5'ACATGATTAATTGTGTGGACC3' |
| 344 | L11 | 5'GGTGCAGAGGTGACTTCG3' |
| 345 | L1 | 5'CTCAGTACTGCTTTACTATTC3' |
| 346 | L1 | 5'GAGGAACACTCTCAGCTG3' |
| 347 | L5 | 5'CAGGGAACTTCTCTTACAG3' |
| 348 | L5 | 5'GAATTAGGGTGCAGAGGC3' |
| 349 | L15 | 5'TACTATTCAGGGAAATTC3' |
| 350 | L15 | 5'TGTCTGTGAAGTTGGTG3' |
| 351 | O8 | 5'TGGCTCTTGATGGAAGC3' |
| 352 | O8 | 5'ACTTCAAAGTGTGACTGC3' |
| 353 | L19 | 5'AGGGAACTTCTCTTACAGC3' |
| 354 | L19 | 5'AATTAGGGTGCAGAGGCG3' |
| 355 | L12 | 5'GAAGTCTTCCTATAATATGATC3' |
| 356 | L12 | 5'TGGCTGCATCTGAGGACC3' |
| 357 | A20 | 5'GCCACTAATGCCTGGCAC3' |
| 358 | A20 | 5'CTGCTGTCAGCAGAGGGC3' |
| 359 | O4 | 5'CTTCTTATAACATGATGG3' |
| 360 | O4 | 5'AAACGCTCTGAGCAGC3' |
| 361 | L14 | 5'CTCAGTACTGCTTTACTG3' |
| 362 | L14 | 5'GAGGAACAATCTCAGCCG3' |
| 363 | L23 | 5'AGCCAGGCTGTACGGAAC3' |
| 364 | L23 | 5CCCAGCCTCACACATCTC3' |
| 365 | L9 | 5'TGGCCCTTCAGGGAAG3' |
| 366 | L9 | 5'ACCATCAGAGTGTGGTTG3' |
| 367 | A4 | 5'CCAGTGTAGCCATTAATG3' |
| 368 | A4 | 5'TACCAAAACTTCCCAGGG3' |
| 369 | L24 | 5'GGGAAATTCTCTTACTAC3 |
| 370 | L24 | 5'CCCCCTCTACCAATAC3' |
| 371 | O6 | 5'CCATTCAGGGAAGTCTTC3' |
| 372 | O6 | 5'TGAGTCTGAGAAGTGTTG3' |
| 373 | L22 | 5'GGAATTTTCTTAGCCCAC3' |
| 374 | L22 | 5'ATGTTCAGGCTTGTAACC3' |
| 375 | A9 | 5'TCATCTTACAAATAGTTG3' |
| 376 | A9 | 5'TCTGACCATTCCTGC3' |
| 377 | A25 | 5'GGGAAATCATCTTATAAATAG3' |
| 378 | A25 | 5'TGCAGATGAGACTTCTGG3' |
| 379 | A15 | 5'ATTCAGGAAAGTCCTCTC3' |
| 380 | A15 | 5'CAGTGACCTTCAGAGTG3' |

TABLE 2-continued

| ID | Region | Sequence |
|---|---|---|
| 381 | O9 | 5'ATTCAGGAAAGTCCTCTC3' |
| 382 | O9 | 5'CAGTGACCTTCAGAGTG3' |
| 383 | O2 | 5'TTGGCGCGCCTTCTGTTTCCCTTCTCAGGTGCCAGATGTGACATC |
| 384 | O2 | 5'CGCACGCGTGTTTGATCTCCACCTTGGTCCCTCCGCCGAAAGTGAGAGGGGTACTGTAACTCTGTTG3' |
| 385 | L8 | 5'TTGGCGCGCCTTCTGTTTCCCTTCTCAGGTGCCAGATGTGACATC |
| 386 | L8 | 5'CGCACGCGTCCTGGGGGGTTTTTGTTAGGGCTTGTATCACTGTGGGAGGGTAACTATTAAG3' |
| 387 | L4 | 5'TTGGCGCGCCTTCTGTTTCCCTTCTCAGGTGCCAGATGTGCCATC |
| 388 | L4 | 5'CGCACGCGTCCTGGGGGGTTTTTGTTAGGGCTTGTATCACTGTGGGAGGGTAACTATTAAAC3' |
| 3897 | A30 | 5'TTGGCGCGCCTTCTGTTTCCCTTCTCAGGTGCCAGGTGTGACATC3' |
| 390 | A30 | 5'CGCACGCGTCCTGGGGGGTTTTTGTTAGGGCTTGTATCACTGTGGGAGGGTAACTATTATGC3' |
| 391 | L11 | 5'TTGGCGCGCCTTCTGTTTCCCTTCTCAGGTGCCAGATGTGCCATC3' |
| 392 | L11 | 5'CGCACGCGTCCTGGGGGGTTTTTGTTAGGGCTTGTATCACTGTGGGAGGGTAATTGTAATC3' |
| 393 | L1 | 5'TTGGCGCGCCTTCTGTTTCCCTTCTCAGGTGCCAGATGTGACATC3' |
| 394 | L1 | 5'CGCACGCGTCCTGGGGGGTTTTTGTTAGGGCTTGTATCACTGTGGGAGGGTAACTATTATAC3' |
| 395 | L5 | 5'TTGGCGCGCCTTCTGTTTCCCTTCTCAGGTTCCAGATGCGACATC3' |
| 396 | L5 | 5'CGCACGCGTCCTGGGGGGTTTTTGTTAGGGCTTGTATCACTGTGGGAGGGAAACTGTTAG3' |
| 397 | L15 | 5'TTGGCGCGCCTTCTGTTTCCCTTCTCAGGTGCCAGATGTGACATC |
| 398 | L15 | 5'CGCACGCGTCCTGGGGGGTTTTTGTTAGGGCTTGTATCACTGTGGGAGGGTAACTATTATAC3' |
| 399 | O8 | 5'TTGGCGCGCCTTCTGTTTCCCTTCTCAGGTGCCAGATGTGACATC |
| 400 | O8 | 5'CGCACGCGTCCTGGGGGGTTTTTGTTAGGGCTTGTATCACTGTGGGAGGGAGATTATCATAC3' |
| 401 | L19 | 5'TTGGCGCGCCTTCTGTTTCCCTTCTCAGGTTCCAGATGCGACATC3' |
| 402 | L19 | 5'CGCACGCGTCCTGGGGGGTTTTTGTTAGGGCTTGTATCACTGTGGGAGGGAAACTGTTAG3' |
| 403 | L12 | 5'TTGGCGCGCCTTCTGTTTCCCTTCTCAGGTGCCAAATGTGACATC3' |
| 404 | L12 | 5'CGCACGCGTCCTGGGGGGTTTTTGTTAGGGCTTGTATCACTGTGGGAGAATAACTATTATAC3' |
| 405 | A20 | 5'TTGGCGCGCCTTCTGTTTCCCTTCTCAGATACCAGATGTGACATCC3' |
| 406 | A20 | 5'CGCACGCGTCCTGGGGGGTTTTTGTTAGGGCTTGTATCACTGTGGGAGGGGCACTGTTATAC3' |
| 407 | O4 | 5'TTGGCGCGCCTTCTGTTTCCCTTCTCAGGTGCCAGATGTGACATC3' |
| 408 | O4 | 5'CGCACGCGTCCTGGGGGGTTTTTGTTAGGGCTTGTATCACTGTGGGAGGGGCATTGTAAG3' |

TABLE 2-continued

| ID | Region | Sequence |
|---|---|---|
| 409 | L14 | 5'TTGGCGCGCCTTCTGTTTCCCTTCTCAG GTGCCAGATGTAACATCC3' |
| 410 | L14 | 5'CGCACGCGTCCTGGGGGGTTTTTGTTAGGGCTTGTATCACTGTGG GAGGGTAACTATTATGC3' |
| 411 | L23 | 5'TTGGCGCGCCTTCTGTTTCCCTTCTCAG GTGCCAGATGTGCCATC3' |
| 412 | L23 | 5'CGCACGCGTCCTGGGGGGTTTTTGTTAGGGCTTGTATCACTGTGG GAGGGGTACTATAATAC3' |
| 413 | L9 | 5'TTGGCGCGCCTTCTGTTTCCCTTCTCAG GTGCCAGATGTGCCATC3' |
| 414 | L9 | 5'CGCACGCGTCCTGGGGGGTTTTTGTTAGGGCTTGTATCACTGTGG GAGGGTAACTATAATAC3' |
| 415 | A4 | 5'TTGGCGCGCCTTCTGTTTCCCTTCTCAG ATACCAGATGTGACATCC3' |
| 416 | A4 | 5'CGCACGCGTCCTGGGGGGTTTTTGTTAGGGCTTGTATCACTGTGG GAGGGGCACTGTTATAC3' |
| 417 | L24 | 5'TTGGCGCGCCTTCTGTTTCCCTTCTCAGGTGCCAGATGTGTCATC3' |
| 418 | L24 | 5'CGCACGCGTCCTGGGGGGTTTTTGTTAGGGCTTGTATCACTGTGG GAGGGAAACTATAATAC3' |
| 419 | O6 | 5'TTGGCGCGCCTTCTGTTTCCCTTCTCAG GGACCAGAAGTGACATC3' |
| 420 | O6 | 5'CGCACGCGTCCTGGGGGGTTTTTGTTAGGGCTTGTATCACTGTGG GAGGGTAATTTTTATAC3' |
| 421 | L22 | 5'TTGGCGCGCCTTCTGTTTCCCTTCTCAGGTGTCAGATTTGACATCC 3' |
| 422 | L22 | 5'CGCACGCGTCCTGGGGGGTTTTTGTTAGGGCTTGTATCACTGTGG GAGGGTAACTGAAGTC3' |
| 423 | A9 | 5'TTGGCGCGCCTTCTGTTTCCCTTCTCAG GAGTCAGATGTGATTTCC3' |
| 424 | A9 | 5'CGCACGCGTCCTGGGGGGTTTTTGTTAGGGCTTGTATCACTGTGG GATGGCTGCTGTAAG3' |
| 425 | A25 | 5'TTGGCGCGCCTTCTGTTTCCCTTCTCAG GAGTCAGATGTGATTTCC3' |
| 426 | A25 | 5'CGCACGCGTCCTGGGGGGTTTTTGTTAGGGCTTGTATCACTGTGG GATGGCTGCTGTAAG3' |
| 427 | A15 | 5'TTGGCGCGCCTTCTGTTTCCCTTCTCAGGTGCCAGATAT GACATGC3' |
| 428 | A15 | 5'CGCACGCGTCCTGGGGGGTTTTTGTTAGGGCTTGTATCACTGTGG GAGGGTCACTTTTATAC3' |
| 429 | O9 | 5'TTGGCGCGCCTTCTGTTTCCCTTCTCAGGTGC CAGATATGACATGC3' |
| 430 | O9 | 5'CGCACGCGTCCTGGGGGGTTTTTGTTAGGGCTTGTATCACTGTGG GAGGGTCACTTTTATAC3' |
| 431 | V7 - 8 | 5'TTGGCGCGCC GGAGGAAACAGAAACACAG3' |
| 432 | V7 - 8 | 5'CGCACGCGT CAGCTGCTCGTCCTGGG3' |
| 433 | V11 -10 | 5'TTGGCGCGCC GGAGGGAAACAGAAACAC3' |
| 434 | V11 -10 | 5'CGCACGCGTAGCTGCTCCTCCTGGG3' |
| 435 | V15 -14 | 5'TTGGCGCGCC GAAGGGAAACAGAAACACAG3' |
| 436 | V15 -14 | 5'CGCACGCGTAGCTGCTCCTCCTGGG3' |

TABLE 2-continued

| ID | Region | Sequence |
|---|---|---|
| 437 | V18 -17 | 5'TTGGCGCGCC GAGGGAAACAGAAACAC3' |
| 438 | V18 -17 | 5'CGCACGCGTCAGCTGCTGCTCCTGGG3' |
| 439 | V19-18 | 5'TTGGCGCGCC GAAGGGAAACAGAAACACAG3' |
| 440 | V19 -18 | 5'CGCACGCGT AGCTGCTCCTCCTGGG3' |
| 441 | V20 -19 | 5'TTGGCGCGCC GAGGAGGGAAACAGAAACAC3' |
| 442 | V20 -19 | 5'CGCACGCGTCAGCTGCCCCTCCTGGG3' |
| 443 | V21 -20 | 5'TTGGCGCGCC GGAGGAAACAGAAACACAG3' |
| 444 | V21 -20 | 5'CGCACGCGTCCCTAGCTGCTCCTGGG3' |
| 445 | V24 -23 | 5'TTGGCGCGCC GGAGGGAAACAGACACAC3' |
| 446 | V24 -23 | 5'CGCACGCGTCAGCTGCTCCTCCTGGC3' |
| 447 | V26 -25 | 5'TTGGCGCGCC GAAGGGAAAGAGAAACACAG3' |
| 448 | V26 -25 | 5'CGCACGCGTAGCTGCTCCTCCTGGG3' |
| 449 | V27-26 | 5'TTGGCGCGCC GGAGGGAAACAGAAACAC3' |
| 450 | V27-26 | 5'CGCACGCGTCCCAGCTGCTCCTGGG3' |
| 451 | Genta | 5'AGCTCGGTACCCGGGGATCCTCTAGAGTCGACCTGCAGGC ATGCAAGCTTGGCCGGCCTGGAGTTGTAGATCCTCTACG3' |
| 452 | Genta | 5'AAAACAAACCAATCAGGCAGAAACGGTGAGGAATCAGT GAAACGGCCACTTACGGCGCGCCAAGATGCGTGATCTGATCC3' |
| 453 | Hygro | 5'CGTTGGACCAGTTTACAATCCCACCTGCCATCTAAGAAAGC TGGTCTCATATAACTTCGTATAATGTATGCTATACGAACGGTA ACGCGTGAAGTTCCTATTCCGAAGTTCCTATTCTCTAGAAAGT ATAGGAACTTCTCAGAGCAGATTGTACTG3' |
| 454 | Hygro | 5'GGACAGCAAGCGAACCGGAATTGCCAGCTGGGGCGCCCTCT GGTAAGGTTAAGATGCGTGATCTGATCC3' |
| 455 | | 5'ACTGCACCTCAGCGTCCCCCTGCCCATGTCAGGGCCGATGAA GGGCACAGCGTACGATTACACCAGTGTCAGTAAGCG 3' |
| 456 | | 5'TGTAATACGACTCACTATAGGGCGAATTGAGCTCGGTACCCG GGGATCCTGCGATCGCTCAGAAGAACTCGTCAAGAAGGCG 3' |
| 457 | $J_H$ | 5'GTGTTATAAAGGGAGACTGAGGGAGGCAGAGGCTGTGCTA CTGGTACCTGGCTGAATACTTCCAGCACTGGGGCCAGG3' |
| 458 | $J_H$ | 5'GGCCACAGAAAAGAGGAGAGAATGAAGGCCCCGGAGAGG CCGTTCCTACCTGAGGAGACGGTGACCGTGGTCCCTTG3' |
| 459 | Spacer | 5'AACAACCTCAGGGCTGAGGACACC3' |
| 460 | Spacer | 5'CTGCCCGTTGTCCCTCGAGATGGTGGCACGGCC3' |

SEQUENCE LISTING (460 sequences)

SEQ ID NO: 1 - DNA, 2262 bp, Oryctolagus cuniculus
tttcctttatgcttccggctcgtatgttgtgtggaattgtgagcggataacaatttcacacaggaaacagctatgaccatgattacgccaagctatttaggtgacactatagaatactcaagcttcagctggatgaggcaacagcctgctgcttggaattctgtccatgtgtccgcatgggagtacttggaacctcatctacggcctcccagggtgtgcttagcaggaatctgaaactggaaccaaactaggacacagcactaaacatcctgacatgggaggcaggaatcccacaggctcactccagtgctgctcctgtcaccaccttatcatcactgcatgtacacaactgatttcttcccttgggattcagttgcttgagatcattcaacattaagaaacaggctcctaatcatatgtataattaatcttcaatgtattttaagtatctatttattttattttaagacagtgttatagcaagagaggaagagacctacaaatggagggagaattccttaaatttgttcacttcctgaatggctgccaaaggctggggatggctgagcctaaagtcatgagcctggaacttcctctagtttcccccagggctggaaggggacaaacatggtagacagtgatcaccattgcacttcctacctctgtgagttcaacttgtggactgcatatataactaatgtcacttactatgtgtccacatgtacttgcattatttcttttagtttgtatgctccagggagacccacattttctaatgacagaacaacctccttcttaatgctgaataatattccatgtccaaatgggaaagaatgcattcactgttttatgcacacttgctttgtttgagactgaagtattgtgaacaaagctgcaacctgacaaaggactgtgggtaaattgtgacacagtgacttctacccagtgcttgacctcaactcagagtcatgattactagacacagggaagagcggggaacaggggacggctgataccaggacacaaagcaccactcacaggaaggaataattctgcccacaccacagtgggctgactcagttcaccacaacacacggcaggttccacaaataactagaactaatgcatccaggctgcccaactaagagtgattgaaaggaggtggaaatgtgcatgacactgagttgatctgtgcccatttctaccatgcacattccaatagcactctacacaccactaccatgtacagtgttctgtgttcaggaacagttttaaacagtttaaacagtttttaaactttaaggcaatggatgaataaggaaaaaaacatagttaaccttaaaaaatccacttgagtatttcatctatttaaaagtgggtgacaggaattaggacaaaattggctaagtccccactagggtcacccgtgttcccatcagagaaatgactgagcccagcctcacggcttcccacacttttccctcataatgcatcatgggaaactgtagatgacactacaagcaaatgagtccctaccaccgacgttggaattacagacacagtttcttgcttcagggttcagaaagactaactcctaggggtcataggcatttgggatgtctggggctgtcaacccaaaagcagaaatctcccattgtcacctttgctgtccatctctacatttctgtctctctcaccccttctctctctatcactgtccaaatgtcttttatatagatgataaggaactagtggttatttaaataaatgagggacatgatattgctaacactggatatgagggtaaacacatattaaaataaaacaaggtcattgccttcaactttttgaaattatgataacataaaaattcatatgatctgaatcatatcatagccatcaccgtacaccctcaggtcacctaattctgccccaggccctgtcctgtctgaggcgtctgaccccatgcctgctatataggggcagcacatgcaggtaggcctccctctgcccatgaaaaccagcccagccctcaccctgcagctctggcacaggagctccagccccagcacttcaggtgtccactcagtgagcgcactcaacacagatgctcaccatggagactgggctgcgctggctcctcctggtcactgtgctcaaaggtaatgatggagaacgcgggacactgagtctgggagaggacgtgagtgagaaacacagaaagagtgacagcttcctgaccaggacgtctgtgtttgcagg

SEQ ID NO: 2 - DNA, 7072 bp, Oryctolagus cuniculus
gacacagtgaggggacctcaggctgagcccagacacaaacctccgtgcaggggcgcgcggctccaccagggagcgcacaagacgcactgagcccagattctggtcctgcacaggtgaagcgggagatgaagccctggtttcctgtcatggaactgggatttcctctcctgtaaaagttttgagggaagaattatacttatataattttgtccctcccaacttcaatgacggggagaaagtctgatgtaaaatgaagaagtcctaaatgaaaaatttggttcatggacagcgactgttgctcaccagggtcagagatgtgggaatattgaggacactattgagtctcttccaacctgactcccgacagcaccctcagtgcactgaaagctttggacagtttcagttttccctcataaccagggacagccgagacagggccgtggatctgttaaacagcaactattccacccatccctctcctgccacaaccagcaagtgtgcactgaaccaacctttgactttacgtgtgggtgatccacactcactttctgcagactttaacccgacctgcatttccccttaatcatggaacaatctgtggtccctgtgtgaacgtcacagcactcagggatgtacttgcagctcagctgtgtctcaggctgggcttctgcaggcacctgggaagcctacagggacttcctcatcctctaggtcctgggaccctcctggagggctccctgcatgaactccgaggggaaatgcactggacatcagcagtcaaggtcataactgaatggaaagtgttgggtgtgcacttccagctgatctggttctgctccagtgttgtgggacctcctgcacctgctgtggttcagggagagcagaaagtgggacacacagtggctgtgcactctggggctggagtccacatcacggggagctgtgtctgtggctccagcatgatgaccagtgtcctgaggctggatcacagctgcaggaagagccagtcttagaccatgtgtccagagtccctgctcttcactccatgtcatgctgactggagttatcgctccactttagtctttcatctatttagagagggagacacgcaggctgcatatcacagtgctggatggggcccatttgcacatttccaatacttgtactgaaaatgcaccctggaggacagtagatgatggatgtgttaggaggccccatctccaaggtgggaacactgatgcagttccatgctcctgggttccagctgccaagccttgagtgcactgccttcatttatcatctccataaaacattggcaaacacaacaccagtattcagagatctgaatcttcatgatttcccattttggccatttcattatcataaacgtttaataaataatatttaatataaaatatgaagtacaatgatatgtgttgaataaatgaatgtatactgaatggaataatgaagtcagacttattgacatgtttatcacaaaacccacgtttttcctggtagaatatcttttgtctaatgtcttggaattctgcagacactgtattcccttcactgttgtcaccatgctgtacagtagatccctcaacgtgtggatcctgtgggactgaaactctgaccttgctccttcgtctcttctgttcctcccaagcacagacgttggtcttcaccattgaatttctggcttgttagttcatcctttttatcccatgtacgtagcatcacatattatttggcttcttggcctggatattttagcagagtgtacttaccctgacatattatccttggatattattctccaggatcatccatgttatccaagataccagaatttcttcctctttactgccttataaacttcctgttaaaatataactctgtccatttgtcccattatccatccttcttcaacgctaatttcactggattatatgtgtgacctcttgagaatgacgctgctttaattgaacatgggactgcagagctgtttgccacagtgactgcacatcccgtggtctcctccctgggatttcatattccttctaccaggaatggtgttggaggatcctgtgataattctatttctcagcttctgatgttttccatgaaagctttcctaatttacctgactccagcctttaccaggttatcttctctctcttcctgcacaacatgtgtcagctctggtatgtctggtgatactcagtctgacaaaggtatgggatatctcattgtttctccaacatgtacgtgcatgatgatcccagatttaaagcattcttgtacgtttgcctttacataatttctttaaaaaattacagatatacttttacctcttttaaaacttgcatttgtccaaaaagaaaaagacagagactgacaacagtgatctactgaatcctggagcacttcccagatgcccataaaagctggcatttggtaagaccatagccaggtgcatggaattcagtccaggtctcacgaatgggattaactcagacttctcgtactacctcccagagtgcacattggaggaatctgaaatttcgacctaaactggtacataaacctaagcatcctgatgtgggaggcaggaatcccacaggttaacttcaatgctgctcctgtcacccattttgtcagtcactgcatttgaaaaaattgattgcttcccctgtgattcagttccatgagttcattcaacatttggatctaggctcctaaccatatatatagttatctttcatttattttaaaaatctatctatttgatttgaaaggcagtgttatggcaagagaggaagagaccaacagagggagagagaagcttccatccactggtttccttcctgaatggctgcaaaggctggggaagggcaagactatagccaggagcctggaacttcctccagtttcccacgaggcttgaaggggacacacacttgagtcatcgttgacagagttccctggtccatgagcagggagctggatttgaagtgcagcaagcagggtctgaacccatgctgctgagtgatgctgcatagggatggcagcttaacctgtggggccaaatgttggacaacccatgtgtgacctgaaaatgctttctccccatctgtggttgtctttggttcttcgatcactccctttgttacacaggagctctgtagttgggtccattatcttttgcctatttttgcttggttgcctgtacattggagattatcaaaataccattgcccaaaccaatgtcagcttgcttttgtccaacgttttcttctagaaccgtactgtctcaggtcttgcctgtaaggcattcctcaagttcactctgttctacatctggtgtgagatgaccacataactgaattattttcaggtgcattcaagtgtccccaaacccaggtaacaacaggaaacccatccccatcctgggcttttgtcaccgtgcattctcagaactcacattctcagaacgtgttcctttatttctagattctgttctgccccagggctctgggtgtctatgttatcccagcaccaggcttgatttcagctcagatgtgatgacgcctcctgctttgctatttttcctcaagaccattcagccatcatgaaccctgttttttcatgataattcttgaagttgcttcctggtcctgtgaagaatgtcaggctgtttcacaggaaatgcattgaatctgcaaatcacattgtagcttggctattttaacaaggtcattccctcaaatccatgactacgtcattccaatttacaggtaatcttcagattccttttcactttttaaattattatatattatggaagtaggaagcaagacccctatcttacaccttacatgaaaatccacgcaagatagattaaagatttaatctatgaccctacaccatccagttattagagaacatttaggaaaccctgcaagacactggcacaggaatagaatttttggaaaagacctgagatataggcagtcaaagacaaaattaataaatcggattatatcaaattgagaagtctctgtatggcaaaagaaacacccaggtaattcagaggtatctgagagaatgtgcaaaatatttgaagctatgccactgatagggattaataaccagaatctacaaagagattaagaaatcccaaacaacaaaaacaactgagttaagagatgggccaataactcagacatttttcaaaagaggaagtccaaatggccaacaggcacctgaaaaaatgttgcggatcactagccatcagggcaaagccatccatcatgcagtaccccatagggaggtgtatggagcaaaaaggtttcttgagctcacagctgtagaggctggaagtccaggatcagacagtgagaatgttgtgccatcaggcatcctaatattgtgaacatggatgggagggaccccatccccacacaggaagtcagatgaaaccagggctgactctagcagcactgtgctctgtgcagaagctggggacccaggagatctactgtgatctcctccaagagcagattccccagaagtgaacaatctatttctgtaaacatccagaccgtgcatcccctgccagtgctatcacgttggggccatgctcagcactgatgctgtgaggacaaaccacacccacccccacaggctgctcccagcattccgtgtgaccctgataggtgcactggagacctcagcttcctccatgaggccctgacgttgaatccactcatggcatggagtcctcactggatgcactccccagagacgatgtcatggtttcctcctgcaggtgaatcactttcttactcagtggacacagaggagcagggtctggagtattgaggctgaggaagctgttcctgcagagccgtgagcagagccagcactgcttggtgtgtgtgtgtgtggtcactccaattgagcagctgaaggttgcatgttaggtggaacttaccctccatacttgatgcacagagcctcccatcatgcatgtagggacttcaccacccaatgatcccattgagaggggctctagggaggggacaaggccatgagggttgctgcctgcattgaagggaatacaacccttagaaagatccttcaggccggcgccgtggctcactaggcctatcctccacctgctgcgccggcactccgggttctagtcccagttatggcaccggattctgtccaggttgctcctcttccagtccagctctctgctgtggcccgggaaggcagtggacgatggcccaagtgcttgggccctgcaccctcatgggagaccaggaagaagcacctggcttccggcttcaaattggcacagcgcgccggccatggcccaccaatagaggcggccatttgggggataaaccaatggaaggaagacgtttctctctgtctctctctctctaactctgcctttccaaaaaaaaaaaagacccttcaataacttaagttttaaatttgagttatcacacatgaatcagaaaggagaacatgagaaagagagatgttccgacactgcgctttcccaaatgttgctgtggccaggtctgcttcccagcctagcctggtctcaggtcaacgatcaggtgcattcactagagtgacagggcccaaaaatcctcccataaacttctgggtcctggggctgcaggagcaggaatctggtactgggacccacagctacatatgagaccctggcacttccctgggggatgtgcgcatcttaaacagtgcaactttcaatttattatttccatgaaatgtgatgacacagttaagactaatgtactgcatatttgtgcaaaatatcattttcttactctgctttactctcagtttcattcttttaagattttcagatattttagttaaaaactaagaaaaacacattcacttgggccccacagaacccgaaaactcagggccaccgacttctgccacaaaacctgcatgttgcacagggctgaactggatgaatctgttgtgaaggagcccaaagggtttcaggccttaaagtgacgggaggaggtgggccgcggtgggtgacacaggggcagtgggcagcaccgtgggatgtgatatttgctcttggcataggtgtgatgaggagtgagagaggcacaggtgagtcgcactcaccacacactttcaacatgtgcggctgcctctgtatctatcacagctcaacagcattgcccatggaagcaaaattgcccagcaaagaaatgtgaagagcagacaggcagacactggcaagtggaacaccacactcagatgcacctgtgtggaacctggtcccctgtgcatctctctgtcaaaaatggaatccagcaaaagtgctccttgttctgctgctggcagggagttcttcagacctcaccaggaagccccagtgagtgctgagtgtggactggggcagagctgagtcctgtggtgaggggcacagatcaaggtgctggggattcctcttaccacactggagctggggacacatccacactgtactgatgatttctcctgtaatgttgaatggaccaagacctacgggaacccatgaaaacatgttgtaggtccactcacataaaaggaccaagacagggttcagtgagcaatgagagcacacaattcatcactcatcccataagtgtgcactgacagactgccccgggacactctcatcagtctgggcacagtcttgtctgaggcgtctgaccccatgcctgctatataggggcagaacacgaaattagggcctccctctgcccatgaaaaccagcccagccctcaccctgcagctctggcacaggagctccagccccagcactcccaggtgtccactcagtgagcgcactcaacacagacgctcaccatggagactgggctgcgctggcttctcctggtcgctgtgctcaaaggtaatgatggagaacgtggggcactgagtctgggagaggacgtgagtgagagacacagagagtgtgagtgacagtgtcctgaccaggatgtctgtgtttgcagg

SEQ ID NO: 3 - DNA, 9587 bp, Oryctolagus cuniculus
gacacagcaaggggcctcaggctgagcccagacacaaacctccctgcagggacgcacggctccaccagggggcgcacaagactcactgagcgcagattctggtcctgcacaggcgcagagggagatgaagccctggtttcctgtagggatggggtttcctctcctgtaacagttttgagggaagaattcttcttttatgattctgtccctgctactgaattcctgacacagagaagattgatgtgacaggagaagtcctatatgaaccaattcaggttcagtggtctccaggatcagagatgtgggtctatctgggtacaacgtgagtgttgtccatctgagtcaggacaacgctctcagggcactgccgactttaggacaattttagttttccctttcgaccaggactgctgaggcagggttcttggtctttataaatcagctatttaagtatctcttgcctgtcaaaaggagcaagtgtgctgaactgaaccaacctttgacgctacatgtgggtgatccacactcactttctgcagactttatgctcgatttctatttacctttaacatgaacagtctgtggtccatgtgtgaacgtcacagcactcaggaatgtacttgccactcggctgtgtctcaggctgggcttctgcaggcacctgggaagcctacagggacttcctcatcctctaggtcctgggaccctcctggggggctccatgcctgaactcaggagggaagagcactggacatcagcagtcaaggtcataactgaatggaaagtgttgagtgtgcacttccagctgatctggtcctgctccaatgttggggaccccctgcacctgctgtggatcagggagatcagaaagtgggacacacagtggctgtgcactctggggctggagtccacatcacagggagctgtgtctgtggctccagcatgatgaccagtgtcctgaggctcaaccatagctgcaggaagagccagtcccagcgaccatgtgtccagagtccctgctcttcacccagtagctatgctgatgtcatcaataacccattgtagtttttcatcaattttagagtagtagagacacccaggcttcatatcaaattgctgcactgaatctatttacaaaatttcccacacttgtaatgaataataaacctggaagacagtagatgatggatctgttatgaggtcccatctctaagatgggaacactgatgcagttccatgctcctgggttccagctgccaaaccttgagtgcactgcctttatttatcatctccataaaacattggcaaacacaacaccagtattcagagatctgaatcttcatatttggacatttttctcttttgattttcataaatgtttgataaataatatttgattatggacataagaggtacaatgatatctgttgaaaaaatgaatgtgtattaatggaattatgaagtcattcttattgacatgctcatcacaatcccacttgtttccaggtatagtatcatttttctcctgcttgcaattctgtggacacaatattctcttaactgctgtcaccatgctatacagatcattcaaagtgtggatctgtcagactgaaactctgaccttgctccagcgtctcctctgttccgccctcactcagactttggtcttcaccattgtatcctgcctctgtgagttcatccttttgatcccacgtaactagcatcaactattattgtctttttgtaaggatggtgagcagaatatacttatcctgacctattatccttggacattattctccaggatgatccaagttgtccaaaatacaaaattccctccactttactgccatataaacttcttgttaaaatacaactttgtccatttcctcaattgttgatttccttattcaatgaaaatttcactggattattgtgtgaactcttgtgaatgaccctgcattaactcaatgtggaactgcagaggtgtttgccacagtgactgcggatcggtggacccctccctgggatttcatattccttctaataggcaatgccgtttgaagatcttgtgataattctatttcccagtttttcatgcttttccataatgtttttgtctatttaccgggctccagccttggaccaaggttgacatctctctctctactccttcatgaggcttgtaggtctgatatctctgataatactaattctaacaggaggaatggcatgtctcactgtgcttctaacatggaaatgcatgatgtttgcctttacatatgcactttgaaaatttgaagatactatttcatttattttaaaatttgtatatacatattttccataaacaaaaagagactgagactgacagtgatcttctaactcctgggtcacttccccgatggctacaaaagcttcagctgggtgaggcaacagcctggtgcttggaattctgtccagggctccacgtgggagtacttggaacatctcccacggcttcccagaggggcttaggcaggaatctgacactggaaccaaactaggacacagcactaagcatcctgacacgggaggcaggaatcccacaggctcactccagtgctgctcctgtcaccaccttatcatcactgcatttaaacaactgatttcttcccttgggattcagttgcttgagatcattcaacattaggaaacaggctcctaatcatatgtataactaatctttcaatgtttaaaaaaaacctattttttatttgaaagtcagtgttatagcaagagaggaagagaccaacagatggagagagaatcttccatccactggttcacttcctatatggcagcaaaggtgaggttgggcaagcctaatgccaagagcctggaactttctccagtttcccacatggcttgaagggggcacacacttgagtcatcgttgacagagttcccaggtctggatcccagcagggagctggatttgaagtagagcaagcagaatctgaacccatgctcctgagtgatgcatgccacaagtcggccccctcggctatgatctgaaaatactttctccccatcggtgatcatatccttgttcttcaatctttctctttgttactcagaatctgtagttggatccattattctttgtctatgtatcttggttgcctgtactttggagattatcaaactatcattacccaaaccaatgggaacttgcttttgtcctgtgtttttctctagaactttacagtctcgggtctttcctttaagagtttcatcctgttcactctttttgggatactggtgtgagatgacagcatgatgaattattttaggtgcattcaagtttccccaacaccatgaaattccacactcagtttcctgaacatttcagatgacctcattgcatgaactcatgggaagcacaggtggacatttgtattcaaggaatagtctgtttggaaagcgtgtggtgtggacttacaggttctgtttctgctccagtgtggtggaatccgctgcactgcggtgtctcagggtgagcagagggggacagtccagggccctgactctggggccagagtcgccatccctgggatctggctgccaggggctgccacacgctgacccatctggtgagctgaatcagtgctgcgtgatgagccagccctggaccatctgtctagagtccccactcctccctccctggctccccctggctgtcctcatcagtacttcatcctttccaagtgagaaaataactcctcttctgtcaagttcatactcctcaaggggaaaccaagttcctgcagccagaaatgcccagtgcagcgattccctgtgttttacaggatattttctgctaaattgcaattgatctgccatgaacagttcttacagaaactgcagccagtcactcacctcatgcagcaatgtgtgttctgagtgactcccatctaaatccagagacacaaaaattcctactaaattaaaacagttgacatatctctgccttttctgagagaagattgacaaacagaaagtgcttctatttagctggggacagttttcatgcattcacctagagaattcattgacacaatccaccatctgacacagtgaattccgttgttctgtaagaacacctcatatctacagtactaggaaatgtgaaatttaatttgtcagatatctacaagaaattgccccaccaagagaattcactcaaattataactgacagaatcatattccatttgtttgaacaccatgacagagtctccccccaggttctgatgggctgtcagttgtataagatgctgtgtccccagggtgacaaatgcaccatggtgagaagagggaggtcctgttctgggcagcaggactggggtctctgatgactgtgttttcaaggagttggcaggtgggccttggtaggtccatgaagaaacggcttgtgaaaccagttggacacagggagattggggggtaactaaacagcacagagagaggtttccatggacttgatctgagtgaagacaggggctcttctaaaatgactcagcttcacacatgggaggggaggaattcgagagggcagtgatgataaggtggtgacaggagcagcactggagtgagcctgtgggattcctgcctcccgtgtcaggatgcttagtgctgtgtcctagtttggttccagtgtcagattcctgcctaagccactctgggaagccgtgggtgatgttccaagtactcccacgtggagccctggacagaattccaagcagcaggctgttgcctcacccagctgaagcttttgtagccatcggggaagtgagaacacccagaacacggtgtctctgcaaatgaatagtctgacagctgcgacacgaccctgtattactgtgcaaagcagctgagcccagacagaaacctccctgcaggggctcgagtctccaccagggggcgcacaagactcactgagcgcagattctggtcctgcacaggtgaagagtgagatgaagccctggtttcctgtcagggaattggggtttcctctcctgttacagttttgagggaagaattcttttatgattctgaccctgctactgattcacggagaagtttgatgtgacaggagaagtcctatatgaacgaatccaggctcagtggtctccaggattaccaggatcagagatgtgggacaatctgggtacaacgtgagtgttgtccagtctgacaggacaacgctctcagggcactgccaactttagggaaattttacatttccctttcgatccagcgatagctgagccagggtttggtgtttaaaattggctatataagtatctctctcctttcaaaatgagcgactgtgctgaactaaaccaacctttcattttacactgtgggcaacaaacactccctttccacagactttattcccaatctccatttaccatttaatcctaacacagtctgtggtccctgtctgaacgtcacagcactcaggactgtacttgcagctcagctgtgtctcaggctgagcttctgcaggcacctgggaagcccacagggacttcctcatcctctaggtcctgggaccctcctgtgggctccctgcctgaactcaggagggaaatgcactggacatcagcagtcaaggtcattactgaatggaaagtgttgagtgtgcacttctagctgatctggttctgctccagtgtcatgggaccccctgcacctgctgtgattcagggagagcagaaattgggacacacagtggctatgcactctggggctggagtccacatcacggggagctgtgtctgtgggtccagcatgatgaccagtatcctgaggctcgatcacagcttcaggaagagccagtctcagagaccatgtatccagagtccctactcttcactctatgtctacgctgactggaatcatcaatccatttggaatccttcatcagttttagagagggagtcactcaggttgcatatcagagtgctggactgaatgcatttgcgttctttttttttttttttttttcacagtcagatttagacggtgggagagagagagagagactaagataaaagtctttgttccattggttccaccaaaatggccgctacggccagcatgctttgccgatccaaagccagaaaccaagtgcttcctcctggtctcccatgcgggtgcagggcccaagcagttgggccatcctccactgtcttctcaggccacatcagagagctggagtggaagaggagcaactgggtcagaatctggtgccgtaaccaggactagaacccagattagcctagtgagccacggcactggcccacatttacattcttaactacacttgtaactgacagtgcaccctggaagacagcagatgatggatctgttatgaggccccatcaccaaggtgggaacactgatgcagttccatgttcctgggttccagctgccaagccttgagtgcactgcctttgtttatcatctccataaaacattggcaaacacaacaccagtattcagagtattgaatcttcatgatttgccatttttgccatttcattatcataaatgtttgataaataataattgaatatagacatatgaggtacaatgatattgttgtaaaacaaaggtatcaaattgagtggaattatgaagtcactcctattgacatgctcatcacaaaatccacatgttcccatggtagattgtcagttgtcttctgttttggaattctgtagacacaatatttgcttaactgctgtcaccatgctgtacagtagatccctcaacatgtggatcctgtgggactgaaactctgaccttgctccaacgtctgctctgttccatgcccttttcttccattattgattccttcttccatgaaaatttcactggattatatgtgtgaacactcgcgaacgacgctgctttaattgaacatggaactgcagttgtattttctatagagactgtgaatcccatgcacatctccctggggtttcacattcctgctacccaaaatgctgtttgaagatcctgtgataactgtatgtctcagtttttgatgactttccataatggatttactaatttacctgactccagccttgtgcaaccagagtggtcatctctcttccttcacaagaattgtcagctctggcttgtctggtaatactcattctaacatgaaggatgggacatctcattgtgcttctaaaatgtacatacatgatgatctgagatttatggcattttacatgtttgcttttatatcatttcttaaattttatagatgtaatatacatttaaaaattcatagattttgttttaaaatttgtatgtacgtttttatctaaaaccacaaagactgagactgacagtgatcatctaactcctggtcacttcccaggtggctacaaacgcttcagctggaacaggtgacagccaggtacttagaattcattccaggtctccaacttgggagttcttggaacttcacctacggcctcccagagtgggcttaggcaggaatctgaaactggaacaaaactaggacacagcactcagcatcctgatgcaggagcagcaatcccattgctaactccagtgctgctcctctcaccaccttggcagtaactgcatttaaacaattgatgtcttcccttgggattcagttttctgtgtttattcaacatatgcatataggctcctaatgatatataaaattaattttccatttattttaatatctatttatttagtttgaaaggcagtgttatagcaagacaggaagagaccaacagatggagagagaagcttccttccacaggtttccttcctgaatggctgcaaaggctggcatggctgagcctgaagccaggagactggaacttcccccagtttcccacagagctggaaggggacaaacacttgggtcatggtagacagtgatctccattgcactccctacctctgtgagttcaagcttgtggactgcatatataactaatgtcaaatactatgtgtccacatgtacctgcattatttctgttagcatattatgctcaaggctgacccaagatttcctaatgacagaacaatctccttcttaacactgaataatattccatgtcaaatgtaacagactgcattcaccgttttatgcacatttcgctttattgtagactgaactattgtgaacacagctgcattacctgaacccaggaatgtggatgaattgtgacacagtgacttcatacccagtgcttgagctgaactaagagtcatggttactagacacagggaagagagggaacagcagatggctgctaccaggacacaaagcaccactcaaagcaaggaataattctgcccccaccacagtgggctgactcagttcactacaacccacgacatgttccacaaataaacagtactgaggacacccggtctcccaacacaaagtgatggaacaaaggtagaaatgtgagtgacagtgaattgatctgtgcccatttctgcaatacacagattccaatagcacactacaccccactaacatgcacagtgttctgagttaatgaacagttttcaaataaggtaatggatgaataaggaaacaagacatagtatccttaaatgaatccacttgcagtctttcatctgtgtaaatatgggcggcaggcattaggacaaaattggcaaagtccccactagggacacccgtgttcccatcagagtcctgggctctttcctgataacacatcgtggtaaactacagatgacgctatagtgatagagcccctacaactgacaaaggaaacacagacgcagttctgggctccaggttttagaaaggctaactccaagatgttgtaggcatttggggagtttggggctgtcaatccagaggcagaaatctcccattttcatcttttctgtccatcactacacttgtgtttctctcaccccatctctctatcactattccaatgtctttcatatagatgatagagaggtcaatagatgatatgaaccaattgttatttaaaaaatgaaggacatgatattgctaacactagatattaagggtacacacatagtaaaaggaaacaaggtcattgccttcaactgttataaaaaagcaataaaacataaaaattcatatgatccgaattctatcatagccatcacccccaggacatgtacatctgccctgggccctgtcctgtctgagacgtctactccagggctggctatataggagcagacatgcaaatagggcctccctctgcccatgaaaaccagcccagccctcaccctgcagctctggcacaggagctccagccccagcactcccaggtgtccactcagtgatcgcactcaacacagacgctcaccatggagactgggctgcgctggcttctcctggtcactgtgctcaaaggtaatgatggagaacgtggggcactgagtctgggagaggacgtgagtgagagacacagagagtgtgagtgacagcttcctgaccatgtcgtctgtgtttgcagg

SEQ ID NO: 4 - DNA, 15475 bp, Oryctolagus cuniculus
gacacagtgaggggccctcagactgagcccagacacaaacctccctgcagggacgcgcggctccaccagggggcgcacaaaacgcactgaatatatattctggtcatgggtaggtgcaaagggacattaagccctggtttcctgttagggaattggggtttcctctcctctaacgcatttgaggaaatggttctattcttacgattctgtccctgccactgacttcactgacggatagaaactttgaatagggacttagcagaagatggcagaatagagagggagggagcacattgaagctccactaagggaaggttcaaagagggatgaaaatttgtagtttttaagcccttcctcaaactggggtgttagggtggacacgcgaggaggacgcggacgcctgagactcaggacaccagcaggagcatgtacgcaccagcgctggaagccgaggtgagacagggcgctcgcccagctccgcagcacagctgcctccgcccctcccccaacacatcctgggacggacactgagacatgcacgactgagtgtgggaggaaatagaaaacggaacagagtgagtggcacccacagagagagtgcaggattcagggacactaattgagagtctgagtaagccagtatctcttggcgcctccccggagctccagcaggcgggaagcagccattttgtttgtttacattcgggcttaaaggagaactatctttgcctccacactaaccttcagaggcggagcccaaaggtggagctgagggtactcgagggagggcagcccgaagccctgagacccgactactcaagttcctgaatagcgcctcctggtggggaaaaaggacaggatccagagctgcagtgggcagagagcagccatcctgtctgtttacctgcgggctgtgtagagcagcctggttacacaggatattggtagagactcacagcagcctatagtagagggaaatcaacccgaaaaatcacccagacggaatgccaaaaaacaaaaccaaaaaccaaaaaaaaacatagaagataatataaatttgccaatagagcaggctaaaccaaccataacagcggcagaagaagaagaccgaatatcagaattcaaagacaaaattccagaaataatacagtcagttcaatcgcaggaagaagaaattaaaaaattaaaaaacacggtcggagacctacaagattcaatcaaacggtgtaatgttcggataataggagtccctgagggggtggaaagagagagaatggattagacggtgtcttcaacgaaataatatcagaaaactttaaacaaaggcagctggataacaacacacaaatacaacagataaccaggaccccgaacagagtagaccagaagagaaattcaccacgacacattgtggcaacactcagttcagtgacacacaaagaacaaatcctaaaatgtgccagagaaaagcgacaaatcacattcaggggtaagtcaatcagactcaccccagacttctcatcgcaaacactacaggcaaggagacaatggcatgatatatttcaagttttaaaagacaaacaatgccaacctagaatactatatcctgcaaagctatcatttgtgaatgaaggggaaataaagatcttccacgacaaacagaaactgaaagaatttgtatccacgcgtccaaccctacaacacttgctcaaagatgtgctgcacacagaaatacaaaaacaagaacttcactgcaaaaaaagcgaatgtagagtaacccacaaacaaagttcaaaatgcataaacagctcgtttcaggaaacatgaagggaaaaagacagtacttaacagtattcacattgaatgtgaatggtcttaattccacgacaaagaggcacagactagcagattggattaaacaagaggatccaactatatgctgccttcaggagacacacctcatcagcaaggatgcatgcagactgaaagtgaaaggatggaaaaagatactctaagctaatggaaatccaaaaagagctggtgtggccatcctaatatcagacaaaatagactttaacataaaaactattaaaagagacagagaagggcactatataatgattaaaggatctatccaacagaaagacattactattataaatgtatacgcacctaattacagggcgcctggctacctgaaagaattactaaaggatttaaagggagatatagactcaaatacaatagtagcaggggacttcaacaccccactctcaccaatggacagatcaaccagacagaaattcaacaaggaaacaactgagctaattgacgccatagaccaaatagacctaatagatatcttcagaaccctccaccccacagacacagagttcatgtatttctccccagtacatggaacattctctaggattgaccatatactaggccataaagggagccttaacaagttcaaaaaaattgaaactataccatgcagcttctcagaccatagtgcagtgaaacttgaaatcaacaacccaagaatctctacaccatatgcaaatatatggagaatggacaacatgatcctaaatgaacagtgggtcatcgaagaaattaaaagagaaatcaaaagatttctagaaacaaatgaaaatgataacacaacctatcaaaacctgtgggacacagcaaaagcagtgctaagaggaaagtttatagcaattagtgcctacatcaagaagctggaaaggaaccaaacaaatgaactctccatgcacctcaaggaactagaaaaacagcagcaaatcaagcccaaatccaaaaggaggaaagaaatactaaagatcagagaagaaataaacagaattgaaaccaaaaaaacaatacaaaagatcaacaaaaccaggagctggttctttgaaaaaataaacaaaattgacacaccattggcccaactaaccaaaaaaaggagagagaagacccaaatctgtaaaatcaaagatagtaatggaaatgtaacaactgacacaatagaaataaaaagaatcatcagaaactactacaaagagatgtatgctaacaaattggggaacctggaagaaatggatagattcctggacaaatgccaccttcctaaactgagccgtgaagatatagaaaatctaaacagacccataaccatggaagaaattgaatcagtaataaacgcactaccgaaaaagaagagcccaggaccggatggcttcactgccgaattttaccaggcatttagagaacaactaaccccagttcttctcaaattattccaaacgattgaaagagagggaatcctcccaaattccttctacgaagccaatatcaccttaattcctaagcccggaaaagacacagcagagaaagaaaactacagacctatctccctgatgaacatagatgcaaaaatactcaataaaattctggcaaaccgaatccaactacacatcagaaagatcattcacccggaccaagtgggatttatccctggtatgcagggatggttcaatattcgaaagtcaatcaacgtaatacagcacattaacaatttgagaaacaaaaatcatatggttatctcaatagatgcagagaaagcatttgacaaaatacaacaccccttcatgatgaaaaccctaagcaaatcggggttagaaggaacattcctcaacacaattaaggcaatctatgataaaccaaaggccagcatcatattgaatggggaaaagttggaggcatttccattgagatctggcaccagacagggatgcccactctcaccattgctattcaatatagtcctagaagtcttagccagagccatcaggcaagaaaaagaaattaaagggatacaaatgggaaaggaggaagtcaaactatccctgtttgcagatgacatgatactatatatagaggacccaataaactcctataagaggctactgaaactcatagtccattctcccaaaagcaatttacaagttcaatgcaatgccaatcaaaataccaaagtcattcttcaaagacctagaaaaaacgatgctgaaattcatatggagaaacaagagacccagaatagctaaagcaatcctttacaataaaaacaaggccggaggcatcacaattccagacttcaaagcctactacagggcagggcagttataatcaaaacagcctggtactggtacaaaaacagatggatagaccaatggaacagaatagaaacaccggagatcaatccaaacatctataaccaactcatatttgacaaaggacctaaaaccaacccctggaacaaggacagcctcttcaacaaatggtgctgggaaaactggatgtccacatgccgcagtatgaagcaagacccctaccttacaccttatacaaaaatccactcaacatggatcaaagaactagagttgcgccacgacaccatgaaactaattgagagcataggggaaacccttcaagatatcagaataggcgaagaattcctggagaagaccccaaaggcacgggtaatcaaagataaaataaacaaatgggattacctaaaattgaagagtttcttaacagcaaagaaaacagtcaggaaagcgatgaggcaaccaacagaatgggagacgttattcgcaaactacacaacagataaaggattaacaactagaatctacacaatgatcaaaaacaccacagaatcaaaacaaacaacccaataaaaaaatgggccaaggaccttaacaggcatttttcaaaagaggaaatccaaatggccaacaggcacatgaaaaaatgctcaggatccctagccatcagggaaatgcagatcaaaaccacaatgagataccacctcactccggttagattggcttacatacagaaatcaaccaacaacagatgctggtgaggatgtggagaaaagggggcactaatccactgttggtgggaatgcaagctggtaaagccactatggaagacagtctggagagtcctcagaaacctgaacatagcactaccacaggacccagccatcccactccttggaatatacccaaatggaattaaaggggtgaaaaaagccatttgcacctcaacatttgttgcagctcaattcacaatagctaagacatggaatcaaactaaatgtccatcagcggatgactggataaagaaactatgggatatgtactctagggaatactatacagcagtaaaaaacaacgaaatcagggcattcacaacaaaatggaggaagctggaaaacatcatgctgagtgaaataagccagtccaaaagggatagatatcacatgttctccctgattgatggcaactaaacgagcacctaaaatgatacccattgaagtgaaatggacactatgagagacaatgacatgagcagcccttgtctagactgttgaggaaaaacttactattttattcctttagtatttttgttgttgttgttgttgctcggtatgctctacacaagaccactggttgaactctgcaatcaatgcacaaccattcttaagcgtttaaaaattaataggaaattgatctctgtggaacatgggagtgggaataagagagggaggagatatataggatgacacatactcaatcagacctaccatggtggaactggaaatgtgccaggggatttcaactcaatcttaccaaggaggcaggtaccaatgccagcacacttggtaaagagacaaatataaatacacaactgatccaaaagatagggtaagtgtcgaagagattacacaaataagaccagtgtaagcaaataatgaaagatagaatcaaaaggcttgagaatgatcctgcgggggaagcaggtcacacagcagactcagagaatggcaaatgcccaaaacagcactcctgcctcagaatcaacccttgggacattcggatctgactaaaaggtccatgagagtctcgcaggcatggaaagccatgacatggtggcaaaaaacaatctaaatgaaggatcctggtgaacaacactccagcagaaggatcaggccatcaaggagagaggcgcctttctctgaagggaggaaggaacttccactgtgatatggccttgactaaacaaattcagagttggtgaactcaaggggcttccatagcctagacagctcatagcaagagtctcgggtgattgctgatgtcataaataagagtgccaattgttaaatcaacaacgggagtcactgggttcatgctcccctcgcaggatctctgtccttaatatgtttatctatgaaactcaaaaacaacgttactagtcgaacaataccctatacctggttcggttgtgtgagtgcaacctgttgaaatccctgcttagtatatactaaattgatcttcggtatatgaaggtaaccaaaaatgaaacgtgatgaaggggggagaggggagaggaagtgggtgagggagggccacgggagggagggaggtcggggggaagccacaacaatgcaaaagatgcattttatattctacttaaaactattggttgagctctgtaattaatacacaattactcttaggtgtttaattaatgctataactagtactcaaatagtattttacactttatgtttctgtgtgggagcaaaatgtggtaatctttacttaacatacgctaaattgatcttctgtatataaagataattgaaaattaattgtgatgtgaaggggaaggggagagggagtgggagaggggagcgttgtggatgggagggaagacacgggggggggaggaggctattgtggtccataagctgtactttgtaaatttatgctaattaaataaatttaaaaaaaagaaaaaaatatgtatcacagaagaaaaaacagtgtggtcttaatgaaatcacaataatagtaattttaagaatattaactttgacacggaaattacataattggtagtaacatttcctattatgtggttgtgtaactttggataaaaaaaaaaaaaagctttgaatagaaggaagaagtcctacatgacaatttcgggttcatgactgacaactgtcctcaccgtgatcagatatcatggggatctgtgaggacctcgtgagtcttttccagtctaactcatgctggtgtcctcagggcactgctgactctaggacaattttatttttccctttatatcctggagacagctaagccatggtctccggtctgttaaatctcaactatttccctctcttcctgtcaaagtagcctgtgtgcggaactgaactgacattttattttaaactgtgggtgatccacactcactttccacagaatgtggccacctttaatccaggaacagtctgtggtccctgtatgaacgtcacagcactcaggaatgtacttgcagctcagctgtgtctcaggctgagcttctgcaggcacctgggaagcctacagggacttcctcattctctaggtcctgggaccctcctggggggctccctgcctgaactcggaggggaaatgcactggacatcagcagtcaaggtcatcactgaatggaaagtgttgggtgtgcacttctagctcatctgattctgtaaagtgttgtgggactccctgcaccttctgtggttcagcagagcagaaagtgggacacacagtggctgtgcactctgtggctggagtccacatcagggggagctgtgtctgtggctccagcatgatgaccagtgtccagaggctgaatcacagctgcaggaagagccagtcccagagatcatgtgtccagagtccctgctcttcactccatgtctatgctgactggggtcatcaatgcatttggagacttccatcagtattagagagggagacacccaggctgcatatcagagtgatggacacagcccatttgcatgctttcccagactagtaactgacagtgcaccctggaagacagtagatgatggatgtgttatgaggccccatcaccaaggtgggaacactgatgcagttccatgctcctgggttccagctgccaagcctgagtgcactgcctttatttatcaactccataaaatattggaaaatattggaaagcactacaccagttttcagagtgttgaatctccatttttgatcatttaatcatttcctttacataagtgtttgatatataataccaaaacgtagacatatgaggtacaattatatgtgttgaaaaataaatgtatcaaattgagaggagttatgaagtcagacttattgacatgctcatcagaaaaccacatgtttccacggtagaatgtcagttgtctcctgttttggaattctgtagacataatattcccttcactgctgtgaccatactgtacagtagatcctcagtgtatggatcctgtgggactgaaactctgaccttgctccagcgtttcctctgctcctcccttgctcagacgttggtcttcaccatcatacttcctgcctctgtgtcttcatccttttatcccatgtatccagcatcacgtattatttgtcttcttgtcgtgcatggttagcagaatgtaattaccctgacacattatccttggacattattctccaggatcatctgagttgtccaaaatacagaatttcctcatctgtactgccatataaacttcctgttaaatataattttgtccatttgttccattgttgattctttcttcatgaatatttcactggattgtatgtgtgaactcttgtgaatgatgctgcattagttgaacatggaagagcagaggtgtttgccacattgattgcagttcccctggacacctccctgggatttcatattccttctactcaaaaatggtgtttgaagatcctgtgataattctgtttcagttttgatgattttccataatagttttacttatttacctgactccaatcttgcaccagagttatctccagcttcctccacatggattgtcagctctggattgtaggataatactcattctaacaggaaggatgggatatctcattgtgcatctactatggacatgcatgatgggcccaatatatcattttatatgttgtctttatatcttttttaaaaaagttaaagatactatttcacttattttgatatttgtatttacatattttttcaaaaaggcaaagagactgagactgacagtgatcttctaattcctggtcacttctcagatggttacaaaagcttcagctgggtcaggtgacagccaggtgcttggaattctgtccaggtgtccacatggaagtacttagaacttcacctactgcctcccagaggggcttaggcaggaatatgacactggaaccaaactaggacacagcactcagcatcctgacatgggaggcaggaatccctcaggctcactccagtgctgctcctgtcaccacctatcatcactgcatttaaggaattgattgcttcccttgggatcagtggcttgagttcattcaacatttggaaataggctcctaaccatatgtataattaatgtttcatttattttaagtatttattttatttgaaaggcagtgttatagcaagagagaaagctatcaacagatggagagagaagtttccattcactggttcacttcgtgaatggctgcaaaggctgggatggctgagcctaaagtcaggagcctggaacttcccccagtttcccccagagctggaaggggacaaacacttgggtcatggtagacagtgatctccattgcactccctacctctgtgagttcaagcttgtggactgcatatataactaatgtcacatactatgtgtccacatgtacctgcattatttctgttagcatattatgctccagactgaccaatgatttcctaatgacagagcaacctcctttttaacacagaataatattccatgtcaaatgtaacagaatgcattcaccgttttaggcacatttcactttatttagaatgaactattgtgaacaaagctgcattacctgaacccaggactgcgggtgaattgtgacacaatgacttctatccagtgcttgagctgaactcagagtcatggttactagacacagggaagagggggaacacagggcagctgatatcagggcacaaagcacacacaagaaggaataattctgcccacaccacagtgggctgactcagttcaccacaacccatgacaggttccatgaataatgagaactgaggcctccaggcccctccaactcagagtgtaggaaaggaggtggaaatgtgaatgacaatgagttgatctgtgcccatttctacaacacacagattccaatagcacacaaatcccactaacatgcacagtgttctgtgttcataacgagtgttaaataaggcaatggatgaataaggaaacaaaacatagttaaccttaaaagaatccacttgcagtcttttatctgtttaaaagtgggaggcaggcattaggacaaaattggcaaagtgcccactagggacacccgtgttcccgtcagaatgaatcagtcagccacacgactccccacactttttctgataatgcattttagaaaactgtggatgacagtaaaagtgaatgagcccctaccactgatgtgggaaacaaagttttgggctccaggtcttagaaaggctaaatcctcaatgttgtaggcacttgggatgtctggggctgtcaatcaaaggtggaaatctccctttgtcaccttttctgtccatctctacatttctctttctctcaccccttctctcactgtcactattccaatgttattcaaatagttaaaaatgaaccaatggttatttaaaaatgaaggacatgctaacactggattattaagggtacacacatattaaaatgaaacaaggtcattgccttcaattgtttaaacaacaatgataacgtaaagatttatatgatctgaatcctatcatagccatcaacctacaccacaggacatcacatctgccctgggcactgtcctgtctgaggcgtctgaccccatgcctgctatataggggcagcacatgcaaatagggcccactctgcccataaaaccagcccagccctcaccctgcagctctagcacaggagctccagccccagcactcccaggtcccaaaattgctttttgaactcaaagtgacattgggagactcgtcctaaagttagtagatggtcgagggaagtgtgtcctagcacccgatgtgaaagaagaattggtctgagtatgaatgaatgacccttaccctgggaagggagcaagtgaggacgacagagctgtgggtcatcacgtccagctgcacaggagacaaactcttgtgtttcagaacagcgcagctctcgtagctgtgtagtcaatatcatgaaaggataggatgtcacttatttgccatctgaaaataagaacataagcacgtgcaataatagtgtactgaacactgactcttcacaatgcacgtgctccatttcctagtcataaatgcttgataaataagaattgaacacagataggagtatcaatgaaatgtcctggtgaatagtgcaccccttgtgggttaggaattttgactcactaacgtgttcatacatcacccatgttatcatctgctgtgagaggttggctctcgtccattctgcagggaatgttgaaatgcacagtgtgtttccttaactactgtcgctatactgtgcatgggtcactaactgagtgtctgctctcaacctgaaactcggggaccttgcactaacgtctccccttttccttttcatgctcagcctctgatgatcaccattgaacttcccacctgtatgggctcaacgtttactgcacataagcattcacacatgttatttttctctgatttcctacatattttcatttagtttattatgtccataatccctccaattgtcccaaatgacagaattgaacctatttattggcatatacaacaccatttgaaatatgacagtatgaattgttcagttatccaatcattcctcaatgaaaatttcactgaattagatgaactatgttgtgaatgaggtcactgtaatggacatgtgactgcaaatgcctagacatggtgccatcagaatccttggacacatccctcagacttcatattccctgtatgaaggagcatcatttggcaattttttaaagatttattttcttatttgaaagagttacagagagaggtagagacaaagaaagagatcttccatctgctggttcaccccccagatggccacaatggccggagctctgcatatccgaaggcgggagccagaagcatcttctgggtctcacactaggtgcaggagcccaaggactcaggacatcctctactgctttcccaggccatagcagagaactggacgggaagaggagcagccagaactagaccagaacccatttgagatgccagcacttcaagccagggctttcacccactgcaccacacaggccccagcaattttattccattaacatttcccagggtctttgagatcaagccttgtttgcttatttacttatttatttgaaatgcagagttgcagagaaagaagcaggagagacagagagaaagggtggggaagagcgagagagacagagagagatcttccaactgctggttcactcccccaaatggtcacaatgcccaagtgagccaggccagagacaggatcttgaaacttgattcagaattttcatgtagacatcactcacccccttgctaaatttcctccaggctatgtcatggttttgttgctcctgtgaatgattggcatgggtcccctgggagatcttccccctgggctgaggtctgtgaggactctgagcttctccatcagctgggactcaggtgtctgcagtgttcatgggaggctgtggcctcctgcttatctgtccccaccagggaagaccagtaggttcagttctgtctcccctggagagatgggagggtggatgccctgggctccattccatttttgtaggccacccgagggccctgtgttggtgacatcatggtctctgcactctgagtctggccttgaacatccagtgcaacctggctttggcctgtgctattcattctttttgggtgaagggcgccagatacctaactaagccctcctgctcatctcctctccactaaccatcctctaccaacactaaatagaaatctgtttatttaccctccaacaactaggattgtggtttcatattcccaccatatagcattcttggatgggccagtcagttgaaatactgtgcttctgttcagccatgttgtaaggaaataacatcaaaacacagacaatcgaggaaatgtggaccttggaaggattatctgtcctgatcttgtcagaactaaagcgtgagattggtgaacgtttggggtgggagttcatggacaagcacattttgtccataactgatatttcattggtgttaatattcagcacacagatgttttgaagtgtactcaattcttaacacacacacacactaaaacctaaaaagccatgaattcccctttttatagtgatttcagtgacattcgacttcaaatatggaagaaacacctccttaagaggctttcatgtaccagtatcttcaaagattgctcttacataaatcccacccagtcacaatttaacatcatatacacaaaaaactcatatttcaacctttcacagcacattaacaaaatcattaggtaaactggacaaccacaaccaatgatggtacagagcgcacatcactcctggagctgttaggtggagtgggaagtcctgtgtgaggaacagaggtgtagagtgtggaggtggctcctaccagactagagcccctggacacagcacagcctgtctgtgattccttcagtaactgtgcacgtgttcaagggaggtatccctcatgccagtatcacatttctgtgcttgtgcagacacaacacaggggcaggcactgttgtgcagtgagctgagcccttgttgggagcccacaccctgtgttggagtgatggctcaagaaccagcctctccacttcaggcgctgcttcctgctcatgcacctgggaggcagctgacgacggcccaaggtcatgggccctgcctcccacctggaggacctgcgtggaggtccaggctgctggctttgacctgggcaaggcctggcttctgtggatgtttggggagcaatccagcagtggggtctttccctgtctgtctctccatctctctgtgtgtggcattctgacttgtaaataaatatgcacatatttatatttattcagattcaatgacctttaacatttagctgtaatcacttcatgagtagagtttaaatacatacacaaacgtccccttcctgaatagaattattcatttcacgtagtaggaggctggaaaaggcataaagggaagggagagggcacactgtcacgtagatggtttattctgtgaacagtgtttctatctgtggactcccaagaaacacaccccacacatttctaatgctctccatctgtgtttgctcctacatatgagaaaaacgtggcatttgtgtttctggcagaatacactcaccagaatgatcttcataaaaaaataaaggtggggccagcgctgtggcacagtatgtaacagaccaaatctgcagtaccggaatcccatagggtcactggttcaagtcccagctgctctacttccagtccagctctctgctatggcctgggaaagtagtagaagataatccaagtccttgggcccctggaacaaaatgggagccctggaagaagctcctggcacctggcttccaatcggctaagctccagctgttgcagacaattggagagtgaaccagaggatcgaagacctctttctctaatctttctgtctctccttctctttgtgtgtaattctgactttaaataaataaatatttataaaaataaataaaaatacaggtgaacagaatgcttatctgtccataatcccacagcaaataccacgttccaaggcagtaattggctacttaagttcccaggtcacccacgtctgccctggactctgtcctgtctgaggcgtctgaccccatgcctgctatatagcggcagcacatgcaaattgggcctccctctgcccatgaaaaccagcccagccctcaccctgcagctctggcacaggagctccagccccaggactcctaggtgtccactcagtgagcgcactcaacacagacgctcaccatggagactgggctgcgctggcttctcctggtcgctgtgctcaaaggtaatgatggagaatgcggggtattgagtcttgcagacgacatgagtgagagacccagagtgtgagcgacagcttcctgaccaggacatctgtgtttgcagg

SEQ ID NO: 5 - DNA, 12223 bp, Oryctolagus cuniculus
gacacagtgaggggccctcaggctgagcccagatacaaacctccttgaggggcacactgctccaccagggggcacacaagacacactgagcccagattctggtcatgagcaggtgcagagaaaccaagccctggtttcctgtcagggaattggggtttccgctcttgtaacagttttgagagaagaagtctacttttatgactctgtccctgccactgacttcactgacctggagatgtctgatatgacaggaagaagtcctatatgaacagtttcatgttcgtgaacgatgacagtggtcaccaggatcagacatgtgggactatctgaggaccttgtgagtgttgtccagtctgacacaggatgcgttctcaaggcccagccggctttaggacaattttagttttcccttcaaacccagagagagtcaagccagagtcttgttttttaaacttcaattatttcagtcatccctcttcctatcaaaatgagcatgtaagcaaatagcaccagcagtcttattttaagctgttgttgttccacattcactttctaaagacttacgcccaaactcctttttacctttaatcctaaaaccatttgtggtccctaaggtgaacgtcacagcactcaggaatgtacttgcagctcagctgtgtctcaggctgagcttctgcaggcacctgggaagcctacagggacttcctcatcctctaggtcctgggaccctcctgggggtggctccctgcatgaactcaggagggaagagcactggacatcagcagtcaaggtcatcactgaatggaaagtgttgggtgtgcacttccagctgatctggttctactccagtgttgtgagaccccctgcacctgctgtggttcagggagagcagaaagtgggacacacagtggctgtggactctggggctggagtccacatcacagggagctgtgtctgtgactccagcatgatgaccagtgtcctgaggctgaatcacagctgcaggaagagccagtcccagagaccatgtgtccatagtccctgctgttcactccatatctatgctgactggtgtcatcaatccatttggagtctttcattaatattacagagggagtcacccaggctcatatcagagtgcagcatggagcccatttacacactttcccatacttgtactgacaatgcaccctggaatacagtagatgatggatctgttttgaggcgccatcaccaaggtgggaacactgatgcagttccatgctcctgggttccagctgccaagccttgagtgcactgcctttatttattatctccataaacattgacaaacacaacacaagtattcagagtgttgaatcttcatttgtgatcatttttgatcataaatgtttgataaataacacatgaaaacagacttatgaggtacaatgatatgtgttcaaaaatgaatgtatcaaattgagaggagttatgaagtcagacttactgacatgctcatcagaaaaccacatgtttccatggtagaatgtcagttgtctcctgttttggaattcagtagacacaattttcccttcactgctgtgaccatgctgtatggtagatcctcagtgtgtggatcctgtgggactgaaactctgaccttgctccagcgtctcccctgctcctcccttgctcagacgttggtcttcaccatcatacttcctgcctctgtgtcttcatccttttatcccatgtatccagcatcatgtattatttgtcttcttgtcctgcatggttagcagagtgtacttaccctgacacattatccttggacattattctccaggatcatctgagttgtccaaaatacagaatttcctcatctgtactgccatataaacttcctgttaaatataattttgtccatttgttccattgttgattctttcttcatgaatgtttcactggattgtatgtgtgaactcttgtgaatgatgctgcattagttgaacatggaagagcagaggtgtttgccacattgattgtggttcccctggacacctccctgggattttatattccttctacccagaaatggtgtttgaagatcttgtgataattctatttctcagttttgatgattttccataatagttttacttgtttacctgacttcgatcttgtaccagagttatcgtctctagcttcctccacatggattgtcagctctggattgtataatactcattctaacaggaaggatgggatgtctcattgtgcatctaatatggacatgcatgatggttccagatattttatacgttgcctttatatcttttttaaacatttattgatattatttcacttatttagatacttgcatttacatatgtgttgctcccttgcccgcaaaggaacgacattgttcgcagcttatcggtcttcagtagacatttaatgagaaaataacagtgacagagaaagaatgaagggaggagagtggacagaaaagccccctccttcctcagcacagagcttatatacaaaatctggccaattgcaaacgggctcaagtccatgcacggaaccctccaatctgctgtctgttcacacattgtgcacatgtcctcgggccaatcagatgaggtgtcacacatcaggcaggctcaccgcacagtcctcggtgccatcttgttgtttacaacattctcaactcctctggaaagtcccaaccgtgggaaagcattgccctaaccaaaactagcaacattcgccttgtgataaagacacagcaacagctatcagaccgaccttgacatgtgggctccatggctgcgcatcccatggagccccacatctcccccttctttattatttaaatggcatggaaacgtgcctgtcttaggtacctaatggcgcgctacctgcttacctgtcatggaggtaataggaagcctgtcctaccctctgtcttaggttgctaggagcgcccatcagtgtttacccgtccttgactactgctccatcatgctaagccatacttctttattggggtgagatcgcaaggtgtccagcatagcctgttggattatcaagttggtattctgctgacggagtgctaaggctctgatccatctggcaatgaaggcaaggcccagtggtaccacgacaaacaagcaaccgatagcgacccattctataacttgagccctgtcttaggtaggtactggatgtggagtgtcttacccgtttctgagtaccattttagcccaacattaggtgagagatgaaacatacagccaaatattaattattttttattacaaaggaggtttggtacgaagttttaagtgatgaatgtcagtccatacagactgtagcgaagatagcacaaattgcagaacacacggaaaacatcccatacaaagtatgaaaagcagtaacggtccagcccgcattaataaccaacgaatccattgaaaccctccaaatgaatagtgggttagcaataaatatttgttgcattttactcttttaagtttatcaataacagactctatatatggcattgttagtaatgttaaaacaacattcccctggaacagatttacagcttatatgattttttaacagcaaataatcgatagctgctcggtttaagagtactcctgaacgaacttgatccaattcttcagctatattggatagcgcagtagcagtaaaattgattgttttggtcaccaaacgtgtaagccttcgtagtccacgattatttccataagccaatccaggaactcccactagctgcatagccatggtgaaagcaggtctccaattaagatgacatcatcatcacagttctcaggtaatgagcgtcgctgtcatgcctttggaaataaagatgttagcattggggccacacggcccaatgagcagttgcaaaaatcattaggggctaacaatgtaaaagcaaattggttgcataaaaatacccatcccttaagagcccatgtcccataccagtactggatcaggtccattccattgattggtgataggatccttccattttaccattgttcttaccccagctgtttgtggatgccactgttgatcagatgcaaaacgaccatctttatccaatgtgaaaaaatttaaaatgaataaagcacgtgagagccatttgttaggagaatgggcaagaaccctaaactcccccttttgtttatattattaaaatattgttttaaagtgtgatgtgtacgtataataatgtcttgaccctgaggattataaggaatgtcagtaacatgagatagaaagttacacaaaaatttctaaaagaggcagaaatataagcaggtccattatccattttaatctgttttggagttcctagggaagcaaaagcttgtaagcaacgggcaataacatgttttgtagctttacctgcatgtaaggaagcaaaaataaatccagaacaagtatcaatagacacatgtatctatttttgtgtaccaaatttcatgaagtgggtgatatccatttgccatagttgattgggggaataaatcacgaggattaatttgaaagtgaggtaatggtaactggatggagcaggtagaacagaattttacaatttgtcgagcttgttcttgagtaatattatgttttaagcataatgtatgagcatttaaatgatgtaaaacatgatcttttgttgctgtgttaatagaatatatgcataaagcagaatctgccaaatggttaccctctaccaaaggtctgggaagattggaatgtgctcgaatatgacctataaagaaagggcaggtatgctgccgaatgacagtgcaaatgcgagaaaacaaaggagaagcagctgaggatttaggaaggaatgaacacgttttcaattgaggcaccgataggaacacatatttgctattggtgtgtatgttaactgctacatccaaagtagactgcaatgcaagtgcaacagcagctaatttaactagctgtagagatgaaaaagaggtgttaataacagtatggtgaccatcacaaattacagaagcttgacctccttttaggatattgaataaaggtttaaggtctcctgttgtgaggtggagatgtgcagaaagccaattaatatttcctagaagttttgaaacttatttaaagtctgtaaagaatccaattgtaaggtgactttttgtggaagtattttttatgggtataattggaagtctagatattgataaggatattgaagttgcattttctcaggggctatgctaagaccaaaagcagttaattgctctcttattactgtcagacattgtatcaccaaaaatttctcgggtccagttatcaaaatatcatccatacagtgtataatatatacattgctatattttttgcaaattttttgaagagcagcattaatgaattattggcacaaagtagggctataagccattttttgaggtaagatcctttataggcatctttgcataggttctttaaaatttactgatggaacactgaaagcaaattggggacaattttttggatgtaaaggtatagtataaaaaataatcttttaaatctattattgcaatataagagtcctttggaattgtagtaggcaatggtaaacctggttgtaaagcccccataatttccacagtagcattaacagccctaaggccttgaagcaatcgctatctcccagattttttttctgataacaaaaataggactattccaaggagaattagaaggaactatatgtcctgctgttaattgtttttttttttttaccaatatctgtgcagtatttatattttcctgcagtaaaggacactgattcacccacacaggattatctgatttttattttattttaatttttgtatggggcacaggctgaccagtagccatcaagggaaacccaagcctctctggttatgattgacatttatagtaactggagatgtgatgctttgttgttgtttgcctaaacccttacctggcaaatgaccttgttgaagtatgttaatggtaacaatcttacttggactatgtattaaagcccccatttgagttagaatattacgtctccagagattaacaagtaatgcagccaaaatatatgttttatcctcccattggagcaatatggaactttgtgttaatctttgactctgaccaataccttgcaattgagttatggtaattttctttttttaatttgtgggccagcttgctgctgaaataacagaggcaccagctccagtatctaaaagaccactgaataactttttatttaattttaagaaaaatttgggtcggtcctcctttataggttgtatccgataagcatcagaagattcaaaaccgttattttctctttaatttaaaaaagacttaccaattgaagagaaggggaacagaatcaagtgagcaatgcattgtcctggagttaaagtttcattattggcttgagtcataatttttatcttaccagtaaagtcagtgtttataactccaggaaaaacctgtaacccttttatagttatactacttctgcccagtaggagaccaaaaaacccagttggcaaaggaccaaaaatcccagtagggaggccttgtgggcccatctcaggggtcaatactgtataggaggtggcactgaggtccagtcctgcactaccctctgtggctccatggaggaaattgatagatttagggtgttctgttgagcaacaaatgtcatggcccccaaaatttgttgggatggggcctggggccagccccgcttttagttttttgaactttatttatttaatgaaatttttttattagttttggagtgacatttattggcccaatgccttcctcttttgcactgggggcaaatcccaggaggaggggcttttttggtgtttgacttttggacaatatttgtacatgtccctgttgcccacattgatagtacccttatttatcaggtatagccctccttgttgatttttgtaatgacctaccaagtagagtggcaggtcctgaatgttctgttttttaaattaatttattttgttaattttttattaaagggactgttacagaacacctcagccacaatagccaatcgatccatatctgcgttgtacttatgttttgtagaatttacagtactatgggcattactaggcaattttcacacagcaccagaaaaggatctgtactgagaattaaacatcattagtaatcatcacgggcatgtttaacgttcagcttgactgcatgttcccccgggatgaaacagcagcagcagaggcttgctccggctcccccttaaagcccccaaggacaagggtggctcactgccaagatgttgggcaagcagtgcgtcccgtcccggatcttggccagagagccgagacacgaagcatgcccacctgtttatcagaaaacattcctttatcctcctccccgggagctggccaggctcccaaggagcaggagaaggtcatctggcagacaagttacttgtttatcagagccaaacaaagacacaagcctctccatcccaaaaatttgtccttacatttggccctagaattgtaccaaggtataggcataattaatacatcataagaatataatacaaatttttatacaaatctacatttagcaatcaaacacaataatatccagtatgttttaaggataaattgaaacatatctgagggaactagcctcttattatctgtaattattacatttctgcaggtgtgtggaatcttaactacttgcggcatattttgacttacatttttttttgtagagcaaaccaagcataatctgctcaagcattcctatcaataataggggtagagttagtacataaaacaaaaacagaatgggtagtccggacactttgttaccacaatttttcattttacatagtaatatgaactttataacagagaacatttacttcaaatgaaatatttaaatgcaaggtgagggctgtccagtgtacactgatctacattttttactcccagtgtttcttatccacaacaccctcttcagcaaaccaaggactaattgttttaacagcactgataaactgctctatggtttgtttctttaaccctattttttacatctgcaacaaagttttcacagcatttgtcacggcttgctttgtgttttttttttttttaatgcacatttaaatcttttttgagcaaatcccaatgttgctcatttacgacttcttttgtgaaccaaggactgactattcctatagcattaatgaaccattctatggctcaccttgtttaaccctattccctgtgtctgtaatggagtctttataacttttttatctttttcctaggggccgatttagggagagtcaatggactataccgcggcggcggttcatcctctaaggacaaatttgctagcctagtcaacctgggatataaatgagatgactcccttgagcacaggggcgcactcgatgggggatggtccttcactgaattttcctttgtcttatccagtggctgttccctacagggacctttgtccatctgtttcctgtcccactgactaccacagtcactagactgactatcatgccgagactcctcctgaaccttttctaggagctcgcatccttcatcaagtaaaagccctgtgctctcagtggggtcctgaagtgtctgttcaatgagttgccataatctaagtatttctaccggctctctggctgctctcaactgtctccctactctccaccactgttgctcatctaattggccaccttccacaaaccatggtgacctcttggcaatggctctagtgaatgcgcatactgtagccgccttaacaggcttccccacagcttctaacaagtggatcaacagcatgtgcaacctagtggtggatggagtattgtctatttagaggtaaaaaggaagtttccgcctatttcctggcgtttctgaacactttgtactcccgccttttaagggattcctttacccttttttctggcacttaatttccccgtctttcttcgacggaaccgcggtttctattctttccccagctggatttccgtgcacacgcacgcttaccttttgttccttacctattcctgcgtgtagaaagtggtccaaatccgagtcatggaaccacttgtcgctcccttgcccacaaaggaacgacactgttcacagcctatcagtcttcagtagacttttaatgagaaaataacagcgacagagaaagaatgaagggaggagagtggacagaaaagccccctccttcctcagcacagagcttatatacaaaatctggccaattgcaaacgggctcaagtccatgcacggaaccctccaatctgctgtctgttcacgcattgtgcacgcgacctcgggccaatcagatgaggtgtcacacagcaggcaggctcaccgcacagtccttggctccatcttgttgtttacaacattctcaactcctctggaaagtcccaaccgtgggaaagcattgccctaaccaaaactagcaacattcaccttgtgataaagacacagcaacagctatcagaccgaccttgacgtgggggctccatggctgtgcatcccatggagccccagacatatgtttccaaaaaggcaaagagactgagactgacagtgatcttctaactcctggtcacttcccagatggctacaaaagattcagctgggtcaggtgacagccaggtgcttggaattctgtccatgtgtccaaatgggagtatttggaacttcacctactgcctccgagaggggcttaggcaggaatatgacactggaaccaaactaggacacagcactaagcatcctgacatgggaggcaggaatccctcaggctcactccagtgctgctcctgtcaccaccttatcatcactgcatgtacacaattcatttcttcccttgggattcagttggttgagattattcaacattaggaaataggctcctaatcatatgtataattaatcttcaatttattttaagtattttattttagagacagtgttatatcaagagaagaagagaccaacagatggagagtgaggcttccgtgcactggttcacttcctgaatggctgcaaaggctgggaaggctgagccagaaaccaggagcttggaatttcatccagtttcccacagggttggaaggggacaaacacttgggtcatggtagacagtgatcacaattgcacttctccctctgtgagaataagcttgtggactgcacatataactaatgtcacatactatgtgtccacatctacctggattatttctgttagcacattatgctccaggctgagccacgtttccttatgacagaacaacatccttcttaatactgaataatattccatgtccaaatgggaaagaatccattcactgttctatgcacacttgctttattgtagactaaactactgtgaacacagctgcaacctgaatgcaggactgagggtgaattgtgacacagtgacttcatacccagtgtttgacctgaactcagagtcatggttacagaacagggaagaggaggacacagggcgactactaccagggccaaaagcaccactcacaggaaggaataattctgtagacagaactgtgggctgactcagttcactacaacccatgacaggttccaccaataactagaactgatgtctccaggcctcctaacacagagtgatggaaaggaggtagaaatgtgcctgacactgagttgatctgtgcccttttctacaacacacagattccaatagcacactacaccccactaccacgtacagtgttctgtgttcaggaacagttttttttttttttttgacaggcagagtggacagtgagagagatggagagacagagagaaaggtcttcctttgccgttggttcaccctccaatggccgccgcggccggtgcactgcggatggcccaccgtggtgatccgatggcaggagccaggtgcttcttctgttctcccatgggatgcagggcccaagcacttgggccatcctccactgcactccctggccacagcagagagctggcctggaagaggggcaaccaggacagaatccggcacctggatcaactagaacccagtgtgctggcaccgcaaggtggaggattagcctagtaagccacggcgccagtccaggaacagttttaaactaatacaatggttgaataagaaacaaaatatagttaaccttaaacgaatccacttgcagtccttcatctgtttaaaagtgggcagcaggcactacgacaaaattggcaaagtccccacccgtgttcccatcagagtgctgcttgagcccagcctcacggcttcccacactttttccaggtaacgcatcatgggaaactgtggttgatgctaagagcaaatgagcccctacaagggacctgggaaacacagaaactttttctgcttcaggtattagaagggttaagtcctagatgttgcggacttagggatgtttgggattctcgacccaaaggcagaattctcccattgtcaccttttctgtccatcactacatttctgtctttctcaccctctctctatcactgtcccaatgtctttatatagatgataaggaactagtggttatttaaataaatgagggacatgatattgctaacactggatattaaggatacacactgaattaagatgaaacaaggtatttgccttcaactatttaaaattttgataacataaaaattcatatgatctgaattatatcacagccatcaactacacacccaggacactatgtctgccctggacactgtcccgtctgaggcgtctaccccatgacagctatataggggcagcacatgcaaatagggcctccctctacccatgaaaactagcccagccctcaccctgcagctctggcacaggagctccagccccaggactcccaggtgtccactcagtgtgcgcactcaacacagacactcaccatggggactgggctgtgctggcttctccttgtcgctgtgctcaaaggtaatgatggggaatgcggggcactgagtctgggagaggacgtgagtgagagacacagagagtgtgagtgacagcttcctgaccatgtcgtctgtgtttgcagg

SEQ ID NO: 6 - DNA, 4549 bp, Oryctolagus cuniculus
gacacatgaggggccctcaggctgagcccagacacaaacctccctgcagggggcgcacaagacacactgagtgcagattctggtcatgcataagtgcagaaggagcccaagccctggtttcctgtcagggaactggggtttcctctcctgcaacagttttgagggaagaattcttctttgatgattctgaccctgtactgactctctgatgtgacaggagaagtcctacatgaacgaatttaggttcagtggtctccagtatcagagatgtgggacaatctggggacttagtgagtgttgtccagcctgagtcaggacagagttcataggacactgccgactttagggcaattttacttttccctttcaatccagcaatagctgagccagggtttgagtttaaaaatctgctatttaagtatctctctcctttcaaaacgagcgactgtgctgaactgaaccaaccgtcttattttaaactgtgagtgttctgcatcatttctaacagactttatacccgatctccattttcctttaatcctgaaacagtctgtggtccctgtgtgaacgtcacagcactcaggaatatacttgcagctcagttgtgtctcaggctgagcttctgcaggcacctgggaagcctacagggacttcctcattctctaggtcctgggaccctcctgtgggctccctgcctggactcaggagggaaaaacactggacatcagcagtcaaggtcatcactgaatggaaagtgttgggcgtgcacttccatctggtctagttccgctccagtgtcgtgagaccacctgcacatgtgtggttcagggagaggagaaagtgggacacacagtggctgtgcactctggggctggagtccacatcacggggagctgtgtctgtggctccagcatgatgcccagtgtcctgaggctgaatcacagctgcaggaagagccagtcccagagatcatgtgtccagagtccctgctcttcaattcatgtctatgctccaaatgtcaatccatttggagtctttcattaacattacagtgggagtcactcaggctgcatatcacattgctggatggagcccattttcacgctttcccatacttgtactgacaatgcaccctggaagacagtagatgatggatctgttatgaggccccatcaccaaggagggaacactgatgcagttccaagctcctgggttccagctgccaagcctgagtgcactgccttttttaatcatctccataaaacattggcaaacacaataccagtatgcagagatctgaatcttcatgactggccattgttcatccttttatcccatgtagctacctacatcacatattatgtgtcttcctggcctggatggttagcagagtgtacttttagtgacatattatcctaggcacattattctccagggtcatccaagttgtccaaaattacagaatttcttactctgtactgcttttaaactccttttaaaatgtaactttgtccatttcttcattttccattctttcttccatgagatgtcactggatcatatgtgtgaactcttttgaatgaactcttttaaatgaacaaggaactgcagaggtgtttggcacagtgactgcagatcccgtggacacctccctgggatttcatattcattgtaccatgcaatggtgcttgaagatcatgtaataattctgtttctagtttttgatgcttttccatacggttttactaattaacctgacaagacttctaccagggttatcatctctctctacctccataaaacatgtcagctctggtatgtctgataatagccattctaactggagcgatgcgatgtctcattgtgcttccaacatggacatacatgttggtcccagatttatagcattttacatgtttgcctatatatcttcttttaataatttatagatattatataaattttaaaatttatcattttatttgagaacttgtctttatgtatttgtacaaaaccacagagagactgagactgtcagtgatcttctaattcctgcgtcacttccccactggctacaaaagattttgctgggtcaggtgacagccaggtgcttggaattctgtccagggctcccacgtgggagtacttggaactacacctactgcctcccagagtgtgctcaggcaggaatatgacactggaaccaaacaaggacacagcactaagcatcctgatacgggaggcaggaatccctcaggctcactccagtgctgctcctgtctccaccttatcatcactgcatgtacacaattgatttcttcccttgggattcagttgcttgagatcattcaacattaggaaacaggctcctaatcatatgtacaattaatcttcaatgtattttaagtatctatttattttattttacaaacagtgttatagcaagagaggaagagatcaacaaatggagagagaattccatccactggttaacttcctgaatggctgcaaaggctggggatggctcagcctaaattcaggagcctgacttggatcatggtagacagttttcaccattgcactgcctacctctgtgagttcaagcttgtgcactgcatgtataactaatgtcacatactgtgtgtccacatctacctggatcatttcttttagtatgaatgctccaggctgacccacatttcctaatgacagaacaacctccttcttaatactgaataatattcttagtctaaatgtgaaagaatccattcactgttttatgcacacttgttctttgtagactgaactattgtgaacaaagctgcattacccaaacgcaggactgcgggtgaattgtgacacagtgacttctacccagtgcttgagctaaactcaaagtcatggttacagaacagggaagcgtggccggcgctgtggctcactaggctaatcctccgccttgcggcgccggcacactgggttctagtcacggttggggcaacggattctgtcctggttgcccatcttccaagccagctcactgctgtggccagggagtgcagtggaggatggcccaagtgcttgggccctgcaccccatgggagaccaggagaagtacctggctcctgccatcggatcagcgtcgtgcgccggccacagcacgccaaatgcaacggccattggagggtgaaacaacggcaaaggaagacctttctctctgtctctctctctcttactgttcactctgcctgtcaaaaaataaaaaaaagaacagggaagagggaacacagggcagctgataccagggcagaaagcaccaccaaaggcaggaataattctgcccacaccactttgggctgactcagttcaccacaacacacaacaggttccaagaatgactagaactgaggtctccaggcctcccaacagagtgatggaaaggaggtggaaatgtgaatgacagtgagttcatctgtgcccatttctaccatgcacattccagtagcacacaaaccccactaccatgtacagtgttctgtgttcaggaacagttttaaacagtttaaacagtttttaaactttaaggcaatggatgaataaggaaaaaaacatagttaaccttaaaaaattcacttgagtatttcatctatttaaaagtgggtgacaggcattaggacaaaattggctaagtccccactagggtcacctgtgttcccatcagagaactgactgagcccagcctcacggcttcccacacttttccctcataatgcatcatgggaaactgtagatgatgctacaagcaaatgaacccctaccaccgacgttggaattacagacacagtttattgctccagggttcagaaagactaactcctagatgtcataggcatttggggtgtctggggctgtcaacccaaaggcataaatttccccttgtcaccttttctgtccatctctacatttctgtctctctcaccccttctctctctatcactgtaccaatgtctttcatatagatgataaagaactaatggttatttaaataaatgagggacatgatattgctaacactcgatatgaagggtacacacatattaaaatgaaacaaggtcattgccttcaagtttttaaaattatgataacataaaaattcacatgatcttaattctatcataaccatcacccaacacaccaagaacacagacaacttcccagggccctgtcctgttgaggcatctgaccccatgcctgctatctaggggcagcacatgcaaatagggctccctctgcccatgaaaacctgcccagccctcaccctgcagctctggcacaggagctccagcctcaggactcccaggtgtccactcagtgaacgcactcaacacagacgctcaccatggagactgggctgcgctggcttctcctggtcgctgtgctcaaaggtaatgatggagaacgcgggacactgagtctgggagaggacatgagtgagagacacagagagtgtgcgtgacagtgtcctgatcatgtcatctgtgtttacagg

SEQ ID NO: 7 - DNA, 8980 bp, Oryctolagus cuniculus
gacacagtgaggggccatagagctgagcccatacacaaatctccctgcaggggtgcccggaaccactagggggcgcacaagatgcgccgagcgcagactctggtcatgcacaggcacagagggagatgaagtcctggttcctgtcagggaactggggtttcctctcctgtaacagttttgagggaagaattctactttttgattctgtccctcccaacttcactgacggattgaaagtttgatgtaaaaggaagaagtcctaattgaacgatttagtacatggacagcgactgtgctcaccagggtcagagatgtgggaatattgaggacactattgaatcttttccaacctgacacagaacagcaccctcagggcactgaaagctttggacagtttcagttttccctgtataaccagggacagctgagacagggccgttgatctgttaaacagcaactattccactcagccctctcctgccacaaccagcaagtgttcactgaaccaacctttgactttacatgagggtgatccacactcactttctgcagactttaacccgaccagcatttccctttaatcctgaaacagtctgtggtccctgtgtgaacgtcacagcactcaggaatgtactgcagctcagttgtgtttcaggctgggcttctgcaggcacctgggaagcctacagggacttcctcatcctctaggtcctgggaccctcctgtggggctccctgcctgaactcaggatggaaatgcactggacatcagcagtcaaggtcataactgaatggaaagtgttgggtgtgcacttccagctgatctggttctgctccagcgttgtgggacctcctgcacttgctgtggttcagggagagcagaaagtgggacacacagtggctgtgcactctggggctggagtccacatcacggggagctgcatctgtggcttcagcatgatgaccagtgtcctgaggctggatcaccgctgcaggaagagccagtcccagagaccatttttccagagtcccagctctccactctatggctgtgctgatcggcgtcatcaatccacttttagtctttcctctatttagagaggcaaacacccagcctgcataagagttcttgacaaattccatttacacgctttcccacacttgtaactgacaatgcaccctggaagacagtagatggtggatgtgttatgaggcctcgtctccaaggtgggaacattgatgcagttccatgctcctgggttccagcttccaagcctgagtacactgcctttatttatcatctccataaacattggcaaacacaacacgagtattcagagaactgaatctgcaactggccatttttgtcattttcccttcataaatgtttgataaataatatctgaacataaacatatgatatacaatgctatgtgttgatcaatttaacatatcaaattgataaaaattgattggaaatatgaagtcagagttattgacatgctcatcacaaaacccacatgtttccatggtagaatgtcaattttctcctgttttggaattccatagacacaatattctctctcttttatttttaaagacttattttattcatttgaaggacagagttacagaaagaggtagagacagagagagagttcttccatctgctggttcactccccagattgccataagtgtctgagctgtgcccatctgaagccaggagccaagtgcttcttccgggtcccacacatgggtacagggccccaagtacttcgtcctcttctactgctttcccagaccatagcagagagctggattggaagaggaccagcctggactagaactggcacccacatgggatgccggcacttcaggccagtgctttaatccgctgcaccacatcactgatcccacaatattcccttaactgcagtcaccatgcagtacagtggatcactcaatgtgtggatcctgtcgtagtgaagctcggaccttgctccagtgtctcttctgttcctcccatactcagacttttgtcttcagcattgtacttctgcctctgtgagttcatccttttatcccacataactagcatcacatattatttgtcttcttggcctggatggttagcagagtatacttatcctgacacattatccttggacattatactccaggatcatccaagttgtaaaaataacagaattccctccactttactgccatataaactccctttggatttataattttttccattggttccattatccattcattcttccatgaagatttcactggattatatgtgtggactcttgataatggcatgtggggagcaactcggactagactaagttactgaaattaagacttattctatgcatctgctctcccacaatatggcactgagaagcgagtaaacagcttctacacagctgcttcttgccaatttgattgactgacctgcaggagctgatcctgctcctgattggaggagagcagcgtactcagcgtgtgggtagcagagttgggattggtggaagaggactataaaggagaagagagacaacatgcaccaggaacatctaaggggaacatctggataacagctgagcagccaccaagagagccggctggcggtgtgccgctcccccgtggaagtggggaaagtggcagggggagccacccttccatggaagtggaaggatcggcagccaacccgggaagaaccagcagcaaacccgggaagggccgagcagacaaaagaacagcgcagggtctagtgtcattcctccacgaagagggggagtgacataatgttgccgtgactcggataggaagcctaggtgacataatggtgccttgactcagataggaaacctaggagggaagaagcaggaaaaagtgggaaaatactggagagagattagagagagcctagggaaaagccagatggaaaaagtgccagaagaagttaggattgaaagagaaagtgaaagctagaagaaacttagactcggatacggactgtggggagaagccaggagaaatgagaggggaatattgttggaagaaaagttaggaaacataccgggtagagaaaaatatgttagggaggatgaagccgcgggggcaggccgaagcagagacgtaagctaggtgggattcgtcaagtcagcccagggagcaaaaggcgaaaaactaaaaccagaagcggagatgtaagctaggttggaatccgtcagattagcccagggagcaaaagacgggaagccaaaccaaaaggcggagacgtaagctaggttggatttcgtcaggttagcccggggaacttagactgaaaaccgagaagtggaaacgtgagctaggccctgatttgtggaagccgccgcgcgcagagaaagcgcgcggggcactagcggaaagagcgcacagggcgcaagtagataggaagtgcggggctggcacagaggccgtggtgcgggcgcaaagggcgcggagactgcagagcgcgcacgaagccgggaagctgcagagatgagagaggcgcgggctgaagccccgcagagccgggaagccaccatggggtgaggcgccaagaagctgccttggggcgggcgccgggaagccctgggataagagaaacagaagtatagaagtaaaatgagagaaataggaatgctggcagatagaagtaaaataggagagataggaatgcccggagacatagaaatagagaaaaataaggcctccccacaacatggcaatgagagggctcgggttctgtcatcctgattagtgaggcggtgagcacctgcgggtggctagcagcttatgtgccgcaggtcaccgaagacaggcactttatcaacaccaataagtctccccacaacacagcaatgagagggcttggattcggtctgcctgattaggcaataagcacttgcaggcagctcgagcagagcgtgcactgcagggcaccgaacacaggcacgcatcagtgcctaaaaacctcctcacaacatggcgaagagaggacccggatttggtttgcctgattggtagggcttgtaagcacctgtgggcaactctagcaagcagagcagagtgtgtgccgcggggcaccgaagacaggcgtgtatcaacgccaaaaaataaaaagaaagggggaactgtggggagcaactcggactagactaagttactgaaattaagacttattctatacatctgctctcccacaatatggcactgggagaggagtaaacaacttctacacagctgcctccagtttgaccaataacctgcaggagctgatcctgctcctgattggaggagagcagcgtacttggtgtgtgggtagcagagttgggattggtggaagaggactataaaggagaagagagacaacatgcaccaggaacatctaagaggaacatccggataacagctgagcagccctcgagagagccagccggcggtgtgccactcccccatggaagtggggaaagtggcagggggcgccacccttccatggaggtggaaggatcggcagccaacccgggaaaaaccagcagcaaacccgggaagggccgagcagacaaaagaacagcgcagggtctagtgtcattcctccgtgaagagggggagcgacaatggcgcttcttaactgacaaggaactgcagatgtgtttcccacagtggctgcagatcctgtggacacacccctgggataccatattccttctacccacacgtggtgtttgaggatcctgtgataatcctatttctcagtttttgaagattttccataatggttttactaatttacctgactcaagccttgtaccagtgttgtcatttcttgcttcctcccaaagaattgtcagctctggcttgtctaataattctcatactaacaggagggatgggatgtctcattgtgcttctaacatatacatgcatggtgatcccagatttgtagcatttgcatgtttactttcatatcttcttttaaacatttatattattatatcacttattttaaaatttatattaacatatttttccacaaacacaaagaaactgagactgacagtgatcatctaactcctggtcacttcccacatggctacaaaagcttcagctgggtcaagaaacagcaaggtgcttggaattctgagtggttccaactaaatctggagacacaggtgagtctttgaggtaggaacaaaggagtggggctcatcaattgttttattctgcttgttggctccctaatgaggtaccccagataggaggtgtatggagcaaaaaggtttattagctcatagctgtagaggctagaagtctaggatcagacagtgagaatgttgtactgtcagccatcataatattgtgaacaccatggcagtcttcaggcatcctaatattgtgaacacagacgggagggaccccatccccacacaggacttcagacgaaaccagggctgactctagcagcactgtgctctgtgctgaagctggggacccaggaaatctactgtgatctcctccaagagcagattccccagaaatggacacatcccactaggcctcactcccagagcactcggtgcttttcccatggtcaccctgggagcacatctacaacacaacacctttgggacacactgagctctggtggaatgagaagtccatgccaagatggctgctggaaagcgagcatcagttagtcagggatggattcagcgccacctggcaacggagcctgcctggcaacaggctgtgattggatggcttcagatactgcctggcaacaggctgtgattggttaggcataaaccgccccttgaccggattggctgcctcagctatatgagctgtggtaccaactgaaataaatgagtctgtgggctgcttgcctctggcctgcattcacccaactcctggggtctgtgtggtgactccacgcctcttgcccccaccacaatgaatccatagcaacactgagccacacacatatcacagaggtttgcttctacacccattgtaggcctgatgacgcagaacctgtcgatcaggatgaacaagccaattgtgtatcacagttattttgagactgcagaagactcagaacagttctaaacacagctcatacagatagttccttcttattccttttggatacaggctattgatcatacatttgatacgagaatagtcacttccaatctatgtgtaggctgctcacttctcagtcagtctgtttgtaatgcagaagctctgtagttatgcagcatcatctaaaaatgttttcttaggttgctcaaatttgaagatctgaaaggaaaatcatggacagaccatatcaggaagattttgccctatgtttcctttggtagttttacaaggactttatatctgacattagatcctggttatttcaatgctttttatgtaaacatccagaccgtgaaccccagtcagtgctgttacgttggggccatgctcagcactgatggtgtgaggacaaaccacatccacccccacaggctgctcccagcattctgtgtggtcctgttcagggcactggagacctcagcttcctccatgaggccctgacgttgaatccacacatggtgggagtcgtcactggatgcactcgcaagagacgatgtcattccacatctcccaggcacctgtgcttctttactcagtggtggtcagtgtgggggttgctgggggcaaggacacctgatcagacctcctgactcagtgttctcctgcaggcactgggtcccagcagtgtggcccttccacctctccttacctcctgaacagtagagtacacccctccaccaggtcctctccctcctgctgctggaccctgtcctaactgtcacttccccacgtgccatgcttctcctccccagtcctcagctttggggatgtaggcatcccctgaagatgcagacttctgtgtcttgggggatcagtgctggcacagtgtctggggtggactctgctcacgaacattttctacaggttttcaccaggacatgggtcatgatggtttcctcctacaggtgaatcactttcctactcagtggacacagaggagcagggtctggggtattgaggctgaggatgctgttcctgcagagccgtgagcagagccagcactgcttggtgtgtgtgtatgtggtctctccaactgagcagctgaaggctgcatgttaggtggaacttaccctccatacttgatgcacggagcctcccatcatgcatgtggggacctcaccacccagtgatcccattgagagagggctttagggaggggacaaggccatgagggttgctgcctgcaatgaagtgaatatgacccttagagagacccttcagtaactcaagttttaaatttcagttattcccacatgagggaaggaaaagggagagacactccctcgcatgcactttcccaagtgtcgcttggacaggtctgcttcccagcctcacccagtttcgggacaacaatcaggtgcatccacgagagtgtcagtgcccaaatatcatcccataaacttctgattcctggggttgcaggagtaggaatctgttactgggtgccagagccacatatgagatgcaggcactcccttgaggggtgagcgcaacctaaacagtgaaaattttaatttattatttccatgaaatttaataacacagttaatacgaatgtactgcacagttgtggaaaatatcatatacttactctgctttatttaaagttatattcatatcagattttcagatactttgtttaaaatctaagaagccttcattcacctgggccccacaatacctgaaaactcaatgccttcaccttccgcccccaacaaacctgcatgtcgctcagagctgaactggatgaaatccattgtgaaggaacccaaaggggctcaggccttaatgtgactggaggaggtgggccgggggctgggtgacacaggggcagtggacagcactgtgggatgtgatagttgctcttggcgaagttgtgatgaggagtgagagaggcacagctgaattgcactcaacacaggcacactttcaacatgtgaggctgcctctgtatctatcacagctcaacagcattgcccatggaagcaaaatttaccagctgagaagttgtgaaggacagacagacagacactggcacatggaacaccacactcagatgcacctgcgtggaacctggtcccctgtgcatctctctgtcaaaaacggaatccagcaaaatgctccatgttctgctgctggcagggagttctgcagacctcaccaggaagcccccatgagtgctgagggtggactgggccagagctgagtcctgtggtgagggggcagatccagatgctggactcctgttagcacatggagttggagacacatacagagtctactgatgatttctcctgtaacactgatctggaaccatagctaagtgaacccatgatacaggttatggttccattcacataaaaaggactaagacagggttcaaagtgcaatcagagcacaaagttatcactggttccataagtgtgcactacagacggccccggaaacactattcagtctgggtctgtcctgtctgagttgtctgaccccatgcctgctatataggagcagaaatgggataaggctccctctgcccatgaaaaccagcctagccctcaccctgcagctctggcacaggagctccagccccaggactcccaggtgtccactcagtgatcgcactcaacacagacgctcaccatggagactgggctgcgctggcttctcctggtcgctgtgctcaaaggtaatgatggagaacgtggggcactgagtctgggagaggacgtgagggagagacacagagagtgtgagtgacagtgtcctgaccaggacgtctgtgtttgtagg

SEQ ID NO: 8 - DNA, 12165 bp, Oryctolagus cuniculus
gacacagtgaggggacctcaggctgagcccagacacaaacctccgtgcaggggcgcgcagctccaccagggggcgcacaagacgaactgagagcacattctggtcttgagcaggtgcaggaagagatgaagccctggtttcctgtcagggaattggggtttcctctccggtagccattttgaggaattaattctactcttgttattctgaccctaccgatgacttcagtgatggtgtaaagtttgatgtgaaaggaaggagtcgttaatgaacaacttcggttcataaacaaggacagcagtcaccaggatcagagatcctgggaatctctgaggaccctggtgattcttttccaacctgactcagatagagccctcagggcactgctaactttaggacaattttagttttccttttagaaccagggacagtagagctagggtttttgttctggtaaacctcaactacctaagtcatccctctcctcccatcaaaatgagcatgtgtaccgaactgaacctacattttttttgacaggcagaatggaccatgatagagagagacagagagaaaggtcatccttttccgttggtttccccccaatggctgctgcgacagtcgcactgcgggcagcacacctcacagatccgaagccaggagccaggtgcttctcctggtctcccatgtgtttgaggggcccaaggagttgggccatcctccactgcactcccggaccacagcagagagctggcctggaagaggagcgactgggacagaatccggcgccccgaccgggactaaaatctggggtgccggcaccgcaggtggagcattatagtctattgagacgcagtgctggccacataatgttttcttaatctgtggatgatccatactcactttctacagactttatacccgacctctatttcccattaatcctgaaaacacattgtggtccctgtgtgaacatcacagcactcaggaatgtacttgctgctcagctgtgtctcaggctgagcttctgcaggcacctgggaagcctacagggacttcctcatcctctaggtcctgggaccctcctgtggggctccctgcctgaactcaggagggaaatgcactggacatcagcagtcaaggtcatcactgaatggaaagtgttgggtgtgcacttccagctgatctggttctgttccagtgttgtgggacccctgcacctgctgtggttcagcaaagcagaaagtgggacacacagtggctgtgcactctggggctggagtccacatcatggggagctgtgtctgtgggtccagcatgatgaccagtgtcctgaggctgaatcacagctgcaggaagagccagtcccagagaccatgtgtccagtgtccctgttcttcactccacgtctatgctgactggcattatcaatccatttgtagtctttcatcagttttagagaggtagacaacaaggctgcatatcagagtgctggacagagcccattacactcctccccatagttgtaactgatagtacaccctggaggacagtagatgatggatccattatgaggtcccatcaccaaggtgcgaacgttgatacagcttcatactccttcatacatttccagctgccatattttgagtacaatggcctaatttatcatctcaataaaacattggcaaacacagtgccagtattcagagaactgatctgcagttgagcatttttgttaatctttacatatgtgttttttgaataatacctgtattcattgaatttgtattccttaaaaaataaatttagactgctccaagttggtggaatagggagggagcacactgatagcctggggaaagatagtttaataaaagtggagatactgtagtctcagggaagagttagggaaaaatctgcaaaggaaactgttctggaactagtgggacacaatggaactacatggagggcacgagcgcccatggctcaggaccccagtgctgagtctacacaccaacgcaggaaagggaggtgaggtgaaactgcagtagcccaagacactggcgggaaagcagcagaaaagcctacagggaatgaggcttgaagccccaagggggaaaattcaccatgctaactagaggagagagaaaaaataaaatggaccagtacggacacgattccctctctccactcgccttacaaaggcaagcaagacaaagagcaggtgccatttggatatacataacagctgcaccagctcagggctgtgcccaccctcagccaagcagaaaaacatgactctggtggggagaaataccaggaggttaagacctagtgaatgtgtgcagcttatgaactgggactgtgaaaaaagaaaaaaactgagggtgtgtgagggaactcacagagtacctgagacgtgagtactctcgggagacaccacaaactcagtaaccttggccaaacggtgggagacattgcaggggaatctgagcttacacagagggctgcacagatcctttgtgtggtccttgggacaaagtggacaaatattatacccactggggctagtgctcaggcactggttgccttcaaggagaatagctcatctgtgcagaattacttcccttctgaataaaagagagagaagctttaccatgccaaacctgggtgtgtcaccgttggcacacccttaccataaagaactgcacagagccctctggacacacccaccacaagcctctagagattcaccaaaagcagacagtccacttaatctagggtcatagtataatgagaaaagccaacacagcaaggaaaaaaagaagaagaagaaaccaaagaatatttcccaataccaaacaacaaatgcagaaaccgaggaaacaagaacaaggaagacattatgatgcccccaaatgaacatgacactccaattcaagattatgaagatgatgagatagaagaaatgcaagaaacagatttcaaaaatttatgataagaatatttagaagttatcaaaaacaaattcatgaactacagaaatccttactggatagaaaatctctctcatgaaaatgaaatcttaaggaggaatcataatgaaatgaggaatctagtagaacctgaaattgtgatactgaagagaaatcaaaattaaatgaagaattcaatggaactaatgacaaacaagcttgagagccttaaagactgaatcagtgaattagaagagacaatatcagacttagaagacagagcacaggaaagtatacagtcaaaccataggcaagaaggggaaattagaaattaaaaaaatattgttgggaatctacaggatactattaaaaaaacaacattcgggttctgggagttcctgaaggcatggagagagaaagaaaggattggaaggcctttttagtgagatactagcagaaaacttcccaggtttggggaaggacagagacatccaagcacatagaacccccaataaacgtgaccaaaagagatcctcaccacaacgcgttgtaatcaaactcaccacagtgaattatgaagaacagattcttacatgtggaagagagaaacgtaagattaccctcagaggatctccagttagactcacagcagacttctcattagaaaccctacaggctaggagggaatggcgagacatagcccaggtactaagagaaaaaaattgccagcccagaatattatatcctgctaagctctcatttgtgaatgaagatgaaataaagacttttcatagcaaacagaattgaaataatttctcaccactagtccagccctgcaaaagacccttgaagatgtgttacacacagaaacacagaaacacaagcatcaatacgaaagaaggtaaaggaagaaaaactcccagtaaaagatcacaggaagttcaaagcctatattagaaatatctttgggaaaatggcagggcaaagttactatttatcaataatcacattgaatgttaatggccccagatctccagttaaaagacagactggctgaatggattaaggaacaaaacccacctatttgctgcttacaagaaacacatctttccaacaaaggtgcatgcagactgaacgtggaaggttggaaaagatattccatgccaacagaaaccaaaaaagagctggcatagccatattaatatcagacaaaataaacctcaacacaaaaactattaagagagacaaagaagggcactacataatgattaagggatcaattcaacaggaagatgtaactattataaatgtatatgcacctaattagaggacactagtttatttaaaagattcgttcagggacttaaagggagacttagaccccaatacaatagtactgggggacttcaatactccactttcagaaatatatcaaccagacagatcaacaaggaaacagcagatttaatcgacactatagcccaaatggatctaacagatatctacagaacttttcatcctacacttaaagaatatacattcttctcagcagtacatggaacctattctaggattgaccacacactagaccataaagcaagtctcagcaaattcaaaagaattggaataaagctggaaattagcaactcaggaatttctagaacatatgcaaacacaaggagactgaacaacatgctcctgaatgaacactaggtcatagaagaaatcaaaagagaaatcaaaaactttctggaagtaaatgaggataacaacacaacatatcaaaattcatgggatacagcaaaagcaatgttaagaggaaagattacagcaataggtgcctccatcaagaaattggaaaggcactgaataaatgagctttcaatgcatctgaaggatctagaaaaactgcagcaaaccagaaccaaaactagtagaagaagagaaataattaaaatcagagaaaaagtcaacaggattgaattcaaataattacaaaagatcagccaaagagctggttttagaaaaaaattaacacaattgacaaaccattggcccatctaatcaaaaaaagaaaagacccaaatcaataaaatcagagatgaaaaagggaatgtaacaacacacaccacagaaataaaaatagtaatcagaaattactacaaggagctgtgtgccagcaaacagggaaatctatcagaaatggatagattcctggacacatgccacctacctaaattgaaccatgaagacatagaaaacccaaacagacccataactgagacagaaattgaatcagtaataaagtccctcccaacaaagaaaagcccaggaccggatggattcactgctgaattctaccacacatttaaagaagaactaactccaattcttcttaaactattcagaacaatggaaaaagagggaatcctcccaaattctttctatgaagccagaatcaccttaatccctaagcctgaaaatgatgcagcattgaaagaaaattaaagaccaatatacctgatgaacatagacgcaaaaatcctcaataaaattctggccaatagaatgcaacaacacatcagaaagatcatccatgcagaccaaatgggatttatccctggtatgcagggatggttcaatgtttgcaaatcaatcaatgtgatacaccacgttaacaaactacagaagaaaaatcatatgattatctcaatagatgcagagaaagcattcaataaaatacaacaccccttcatgatgaaaaatctaagcaaattgggtatagaaggaacattcctcaatacaatcaaaacaacttataaaaaacccacagccagtatcctattgaatggaggaaagttggaagcagttccactgagatccggtaccagacagggatgcccactctcactactgctattcaatatagttctggaagttttagccagagccactgggcaagaaaaagaaattaaaatgatacaaaaggggaaggaagaactcaaactatccctctttgcagatgatatgattctttatttaggggatccaaagaactctactaagagactattggaactcatagaagagtttggcaaagtagtaggttataaaatcaatgcacaaaaaccaacagacttggccggcactgtggctaactaggctaatcctccgccttgcggcacaggcacaccgggttctagtcctggtcggggcgccagattctgtcccggttgctcctcttccaggccagctctctgctgtggccagggagtgcagtggaggatggcccaagtgcttgtgccctgcaccccatggaagaccaggataagcacatggctcctgccatcggattagcgcggtgcactggctgcagcacgctgttagcagcagccgttggagggtgaaccaatggcaaaaggaagacctttctctctgtctctctctctcatggtcgactctgcctatcaaaaaaagcctttgtatacactggcaatgccacggctgagaaagaacttctaagatcaatcccattcacaatagctacaaaccaatcaaacaccttggaataaatttaaccaaggatgttaaagacctctacaatgagaattacaaaatcttaaagaaagaaatagaagaggataccaaaaaatggaaaaatcttccatgctcatggattggaagaataaatatcatcaaaatgtccattctcccaaaaggaatttatagattcaatgcaataccagtcaaaataccaagacattcttcgcaaatctgtaaaaaaaatgatgcagaaattcatatggaggcacaggagacctcaaatagctaaagtaatactgtacaacaaaaacaaagctggaggcatcacaataccagatttcaagacatactacagggcagttataatcaaaacagcatggcactggtacagaaacagatggatagaccaatggaacagaatagaaacaccagaaatcaacccaaacatctacagccaacttatatttgaccaaggatctaaaaccaattcccagagcaagcacatctattcaataaacagtgctgggaaaactggatttccatgtgaagaagtatgaagcaggacccctaccttacaccttacaaaaaacccactcaaactggattaaatatctaaatctatgacccgacaccatcaaattattagagaacattggagaaaccctgcaagatatacgcacgggcacagtcttcttggaaaagacctgagaggcacaggctgtcagagccaaaattaacaactgggattacatcaagttgagaagtttctgtactgcaaaaaaacaaaaacaaaaacaaaaaaacaggaaagtggagaggcaaccaacagaatgggaaaaatatttgcaaaccatgcaacagataaaggattaataaccagaatctaaaaagagatcaagaaactccacaacaacaaaacaaacaacccacttaagagatgggccaaggacctcaacagacatttttcaaaagaggaaatccaaatggccaacagacacatgaaaaaatgttcaggatcactagccatcagggaaatgcaaatcaaaaccacagtgaggtttcaactcactccggatagaatcctcacatacagaaatctaccaacaacagatgctggagaggttgtgcggaaagatggatactaacccactgttggtgggaatgcaaactagtaaagccactatggaagtcagtttggagattcctcagaacctgaatataaccctaccatacaacccagccatcccactccttggaattcacccagaggaaattacattggcaaataaaagagctgtctgtacctcaatgtttattgcagctcaattcacaatagctaagacctggaaccaacctaaatgcccatcaacttttgactggataaagaaattatgggacatgtactctttagaatactatacagcagtaaaaaaaaaaaaaaaaaaaaaaaaaaaaaaaaaaaaaaaaaaaaaccaatgaaatccggtcatttgcaacaaaatggagggatctggaaaagatcgtgctgagtgaaataagccagtcccaaagggacaaatatcatatgttctccctgatcggtgatgactaaccaagcaccaaaaagggaacctgttgaagtgaaatggacactatgagaaacagcgacttgatcagcccttgtcctgactgtcgaggaacaacttaatattttatcccttttagtatttttttgttctactaatactattggttgacgtctttaattaacacacaagtattcttaggtgtttaaatttgattgaaaagtgatccctgttaaatatgagagtgggaataagagagggaggagatgtacagtttggcacatgctcaatcggacttgcatcaaatggtagatttagaaacgtgccaggggattccaattcaatccaatcaaggtggcatgtaccaatgccatctcactagtcaaagtgatcaatttcagttcataattatcataatgataggattgggacgagtgtctgctactactaactgatagaattataaaggagagaattattcaacatgggaagtgggatacacagcagactcatagaatgtcagatgtcctgaacagcactctggcctcagaatcagccctttaggcatttggatatgggtaaaaagcccatgagagtgtttcaggcatggaaagccaagacactctagcaaaaaaacatgacctaaatgaaagatctctgtgagtgagatcccagcgggaaaaaaaggccatcaaagaaagacgtacctttctctgaagggaggagagaacttccactttgactatgaccttgtctaaataagatcagagttggagaactcaaaaggcttctatagccttggcaactcgtgagaagagcctagggtgattactaacgccataaacaagagtgtcagttgttaagtcaataaaaggagtcactgtgcacttaactccccatgtagtatctctgtccttaatgtgttgtacaatgtgaattaatgctataacgagtactgaaacagtactttacactttgtgtttctgtgtgagtgtaaactgttgaaatctttgcttaatatatactaaactgatcttcagtatataaagagaattgaaaatgaatcttgatgtgaaagggatgggagagggaaccgttcgacccagccatcccactccttggaatttacccaaaggagtttaaattggcaaacaaaaaagaggtctgcaccctaatgtttatcgcagcagaattcacaatagccaagacctggaaccaacctaaatgcccatcaacggtagactggataaagaaattatgggatatgtattctttagaatactatactgcagtaagaaacaacgaagtccagtcatttgcaacaaaatggaggaaactggaacacatcatgctgagtgaagtaagccagtcccaaagggacaaataccatatgttctccctaatcggtgacaactgactgaacaccaaaaagggaacctcctgaagtgaaatggacactatgagaaacggtgatttgatcagcatagccctgactgttaatgaacaacttaatacattatccctcttagaatttttggctgttttacttaatatgactggtttaattctgtaatttacacacagttattcttaagtgttgaaatttaactgaaatgcgatccctgttaaacataagagtggggataagagagggaagagatgtatagtttgggacatgctcaagctgacctgccccaaatggtagagttagaaacatatcaggggattccaattcaatctcatcaaggtggcatgtaccaatgccatctcactattccaagtgatcaatttcagttcacaattgctcataatgaaaggactaagagtcaaagggagcacataaacaagtctagtacctgctaacactaaccgatagaataaataaaggggagagtgatccagcatgggaagcaagatactcagcagaatcatagaatggcagatgtcctaaatagcactctggcctcagaatcagccctaaaggcattcggatctggctgaaaagcccatgagagtatttcaggcatggaaagccaagacactctggcaaaaagatctctgtgagtgagatcccagtggaaagaacaggtctttaaagaaggaagaacctttctctgaagggaggagagaacctccactttgaatatgaccttgtctaaacaagataagagtcggagaactcagagggcttccatagccttggaaactcatgactggagcatagggagattactgatgccatagacaggagtgtcaatttgtaaagtcaacaacaggagtcactgtgcacttactcctcatgtaggatctctgtccttaatgtgctgttcattgagatttaatgctataacgagtactcaaacagtatatttcactttgtgtttctatgggggtgcaaactgttgaaatctttacttaatgcatactaaactgatcttttgtaaaaaagaaaaagaaagaaattatcaatttccaacttgtctctcactgggattaaacatgacaataggtctgatctgatttcatcatcatttaaaaaaatctattatttttcactttatgtttcagtgtgggagcaaactgttgaaatccttacttaatgtatactaagctgatcttctgtacattaagataataaaaaatgaatcttgatgtgaatggaaggggagagggagtgggaaaggggagggttgcgggtgggagggacggtattggggggaatccattgtaatcaataagtcgtactttggaaatttatattcattaaataaaagttaaaaaaataaagaaacagaaaaaaaaaaggggatgggagagggagcaggagatgggagggttgcgggagggagggaagttatgagggggaaaagccactgtgatccaaaagcagtactttggaaatttatatttaataaataaaagttaaaaaaaaatttaaaaaataaaaaagatttaaatattttaaataatattgttacatggacatcatgcatgctgttcctatatttcctccaaggttttaaaagatgttgaaactgctcgtgcaattttttagaaaagatttatttatttactgaaagtcagtgttacacagagacagggaaagacacagagacaagtcttccatctgctggttcatcccccagatgacagtgacaccaggagacaggtgtttcttcggggtctcccacatgggtgcaggggccaaatactaggaccatgcttttctgctctcccgggtgcatcagcaagagacgattggaagtgccacagctggaacaggaacacacagcactaggggatgcaggcatcacaggcagtggattcacctgctgcaccacagtgatgctttctccatttctgcgcattcattctcagtgtacaaatgcagcaccgatgtttcataattggcacctagtggtggagtatattattctccatcatttcgtgcatgggctctcagccctgagcttggcagtttgtttttgttagaacttccctcttcatgatattccctcgctgccacccagacctagtgtccacatcagggaacacaaaacctcaacttcttatcctgcatctgagcgtccacacatgagacacaagaggcacccgttattcttgctctgatggatgtcactaggcacaaagacctgtatcaaatcaaagatgtcctgaaatcataactgtacagaatcatggaaagaatcatttgttctgtgtcgttacctgtgctactaaacaccagaacctggaacctgtcctatctgaagtgcacaaccccatgcctgctatacaggggcagcacatgcaaatggggcctccctctgcccatgaaaaccagcccagccctcaccctgcagctctggcaaaggagctccagccccaggactcccaggtgtccactcagtgatcgcactcaacacagacgctcaccatggagactgggctgcgctggcttctcctggtcgctgtgctcaaaggtaatgatggggaacacggggcactgagtctgggagaggacgtgagtgagaaacacagagtgtgagtgacagtgtcctgaccaggacgtctgtgtttccaga

SEQ ID NO: 9 - DNA, 4580 bp, Oryctolagus cuniculus
gacacagtgaggggccctcaggctgagtccagacacaaacctccctgcagggccgtacgtctccaccaggaggcacacaagatgcactgaatatatattctggtcatgggtaggtgtagagggacaataagccctggtttccttttagggaattggggtttcctctcctctaatacatttgaagaaatggttctactcttacgattctgtccctgccactgacttcactgacggatagaaactttgaatagaaggaagaagtcctacgtgacaatttcgggttcatgactgacaactatcctcaccgcgatcagatatcatggggatctgtgaggacctcgtgagtcttttccagtctaactcgtgctggtgtcctcagggcgctgccgactctaggacaattttacttttccctttatatcctggagacaactgagccagggtctctggtctgttaaacctcaactatttccctctcttcctgtcaaagtagcctgtgtgcggaactgaattgacattttattttaaactgtgggtgatccacactcactttctgcagaatgtggccacctttaatcctggaacagtctgtggtccctgtgtgaacgtcacagcactcaggaatgtacttgcagctcagctgtgtctcagactgagcttctggaagcacctgggaagcctacagggacttcctcatcctctaggtcttgggacactcctggggggctccctgcctgaactcggaggggaaatgcactggacatcagcagtcaaggtcatcactgaatggaaagtgttgggtgtgcacttctagttgatctgattctgttgagtgttgtgggactccctgcacctgctgtggttcagggagagcagaaagtgggacacacagtggctgtgcactctggggctggagtccacatcacggggagctgtgtctgtggctccagcatgatgaccagtgtcctgacgctgaatcacagcttcaggaagagcaagtctcggagaccatgtgtccagagtccctgctcttcactccatgtctatggtgactggggtcatcaatgcatttggagacttccatcagtattagagagggagacacccaggctgcatatcagagtgctggacacagcccatttgcacactttcccagacaagtaactgacagtgcaccctggaagtcagtagatgatggatgtgttatgaggccccatcacgaaggtgggaacactaatgcagtttcaagctcctgggttccagctgccaagcttcagtccactggaatttatttatcatctccataaaatattggaaaatactggaaagcactacaccagtattcagagtgttgaatctccatttttgatcatttaatcatttcctttacataagtgtttgatatataataccaaaacatagacatatgaggtacaatgatatgtgttgataaataaatgtatcaaattgagtttttatgaagtcagacttattgacatgctcatcagaaaaccacatgtttccatggtagaatgtcagttgtctgctgttttggaattctttaggcacaatattcccttcactgctgtgaccatgctgtacagtagatcctcagtgtatggatcctgttggactggaactctgaccttgctccaacgtctcctctgctcctcccttgctcagacgttggtcttcaccatcgtacttcctgcctctgtgacttcatccttttatcccatgtatccagcatcacgtattatttgtcttcttgtcctgcatggttagcagagtgtacttaccctgacacattatccttggacattattctccaggatcatccgagttgtccaaaatacagaatttcctcatctgtactgccatataaacttcctgttaaatataattttgtccatttgttccattgttgattctttcttcatgaatatttcactggattgtatgtgtgaactcttgtgaatgatgctgcattagttgaacatggaagagcagaggtgtttgccacattgattgcggttcccctggacacctccctgggatttcatattccttctactcaaaattggtgtttgaagatcctgtgataattctgtttcagttttgatgaatttccataataattttacttgtttacctgactccattcttgcaccagagttatctccagcttcctccacatggattgtcagctctggattgtaggataatactcattctaacaggaaggatgggatgtctcattgtgcatctattagggacatgcatgatgggcccaatatatcattttatatgttgcctttatatcttttttaaaaagttaaagatactatttcacttattttgatatttgtatttacatatttttttcaaaaaagcaaagagactgagactgacagtgatcttctaattcctggtcacttcccagatggatacaaaagcttcagctgggttaggtgacagccatgtgcttggaattctgtccagttgtccacatggcagtacttggaacttcacctactgcctcccagaagggcttagacaggaatctgacactggaacgaaactaggacacagcactcagcatcctgacacgggaggcaggaatccctcaggctcactccagtgctgctcctgtcaccaccttatcatcactgcatttaaggaattgattgcttcccttgggatcagtggcttgagttcattcaacatttggaaataggctcctaaccatatgtataattaatctttcatttattttaagtatttattttatttgaaaggcagtgttatagcaagagagaaagctatcaacagatggagagagaagtttctattcactggttcacttcgtgaatggctgcaaaggctgggatggctgagcctgaagccaggagcctggaacttcccccagtttcccccagagctggaaggggacaaacacttgggtcatggtacacagtgatcaccattgcacttcctccctctgtgagttcaatcttgtggactgcatgtataactaatgtcacatactatgtgtccacatgtacctgcattatttctgttagcatattatgctccaggctgaccaatgatttcctaacgaccgaacaacctccttcttaacactgaataatattccatgtcaaatgtaacagactgcattcactgttttaggcacatttcactttattgtagactgaactattgtgaacaaagctgcattacatgaacccaggactgtgggtgaattgtgacacagtgacttctatccagtgcttgagctgaactcagagtcatggttactagacacagggaagagggggaacacagggcagctgataccagggcacaaagcactcacaggaaggaataattctgcccacactacagtgggctgactcagttcaccacaacccatgacagattccatgaataatgagaactgaggcctccaggcccctccaactcagagtgtaggaaaggaggtggaaatgtgaatgacattcagttgatctgtgcccatttctacaacacacagattccaatagcacagtacaccccactagcaagcacagtgttctgtgttcatgacgagtgttaaataagtcaatggatgaataaggaaacaaaacatagttaacctaaaaagaatccacttgcagtcttttatctgtttaaaagtgggaggcaggcattaggacaaaattggcaaagtccccactagggacaccggtgttcccatcagaatgaatcattcagccacacgactccccacactttttctgataatgcattttggaaaactgtagatgacactacaagtgaatgagcccctaccactgacgtgggaaacaaatttgcagttttgcgctccatgttttagaaaggctaagtcctcggtgttgtaggcacttgggatgtttggggctgtcaatcaaaggtggaaatctccctttgtcaccttttctgtccatctctacatttctctttctctcaccccttctctcactgtcactattccaatgttattcaaatagttaaaaatgaaccatggttattttaaaaatgaaggacatgataacactggattattaaggatacacacatattaaaatgaaacaaggtcattgccttcaattgtttaagcaacaatgataatgtaaagatttctatgatctgaatcctatcatagccatcaacctacaccacaggacaccacatctgccctgggcactttcctgtctgaggcatcagaccccatgcctgctatataggggcagcacatgaaaacagggcctccctctgcccatgaaaaccagcacaggcctcaccctgcagctctggcacaggagctccagcctcaggactcccaggtgtccactcagtgatcacactcaacacagatgctcaccatggagactgggctgcgctggcttctcctggtcgctgtgctcaaaggtaatgatggggaacgcggggcactgagtctgggagaggacgtgagtgagagacacagagagtgtgcgtgacagtgtgctgaccaggacgtctgtgtttgcagg

SEQ ID NO: 10 - DNA, 5352 bp, Oryctolagus cuniculus
gacacagtgagggaccctcaggctgagcactgaggacccaggagatctactgtgatctcctccatagcagattccccagaaatgaacaaatcccactaggcctcactcgcagagctccccacacttctcctgtggtcatcttgggagctcacctaaaacacacacctcagccacaagcagatcagagaggtttgcttctacaccaattgtaggcctgatgacacagaacctgtcattcaggatgaagaagctaattgtctatcatagttatttgagaagacttgggaccagttctaaacacacagacaatttttttatttacatatataacagctgatacagacggttcattttatttttacagctcattttatttatccagcgcttacagagatttcctttttatttctttgggatacaggttattcatcatacatatggtatgtaaatagttacttcccttgtgtgtaggctgctcacttctcatcggtccacttacagtgcagaagctctgtagtctatgcagcatcatctgaaaatgttttcttacattgcatgaactttcaggttctaaaagaaaaatcaagggcagactactatcagggagattttgccctatgtttccttctagtagctgtacaatggactttgcatctgatgtcagatcctggttgttcaatgctttttaggtaaacatcaagaccatgcaccccctgtcagtgctgttacgttggggtgaggacaaaccacatccacccccacaggctgctcccagcattccgtgtggttctgttaggggcactggggacctcagcttcctccatgaggccctgatgttgaatctactcatggtgggagtcgtcactggatgcactccccagaggcgacaccattccacatctcccaggcacctgtgctagttttactcagtggtggtcagtgtgggggtccctggggtaaggagacctgatcagaactcctgactctgtgctctcctgcaggcactgggtcccagcagtgtggcccttccacctgtccttaccctcctgcagaggaagagcccacacctccaccaggtcctttctctctatgttgctggaccctgtccccgactgtcacttccccacgtgccatggttctcctccccagtcctcagctttgggggtggagccatcccctgaagatgcagacttctgtgtcttgggggatcagtgctggcacagtgtctggggtggactctgctcacgaacattttctacaggatcccaccaggacattggtcatgatggtttcctcctgcaggtgaatcactttcttactcagtggacacagaggagcagggtctggggtattgaggctgaggatgctgttcctgcagagccgtgagcagagccagcactgcttggtgtgtgtgtgtggtctctccaactgagcagatgaaggctgcatgttaggtggaacttaccctccatacttgatgcacggagcctcccatcatgcatgtagggatcccaccacccagtgatcccactgagaggggctctagggaggggacaaggccatgagggttgctgcctgcatgtggggaatacgacctctagagagacccttcagtaactcaagttttaactttcagttattcccataggaggcaaagaaaaagagagagagacactcccatgcactgcactttcccaagtgtcactctggccagctctgtttcccagcctcacccagtttccagacaacaatccggcacatccacaagagtgacagggcccaaatgtcctcccataaacttctgattcctggggctgcaggagcaggaaagtggtattgggagccagtgacacacatgagacacaggctatcctttggtggatgaacgcatcttaaacagtgcaaattttaatgttttagttcctgtatttccatgtaatttgataacacagttaagactgatatactcacagttgtgtcaaatatgatatacctacactattttactttgaattttattcttatcagtttttcagacccctatcttacaccttacacaaaatccactcaacatagaataaaggtgtaaatctatgtccctacaatatccaattattaaagaacatttgggaaatgctgcaagacattggaataggcaaagagttcttggaaaagaactcaggggcataggcagtcaaaaccaaatctaataaataggattacatccaattgagaagtctctgtacagcaaaaaaaaaaaaacccctcaggaaagtaaagaggcatcttacataatgggagatattatttgtaagctatgcaattgatatagattaataaccagaatctacatagtgattaagaaactccacaacaacataacaaataacccagttaagagatgggccaaggacttacacatttttcaaaagaggaagtccaagtggccaacagacacatgaaaaaatgttcaggataactagctgtcagggaaatgcaaatccaaactacaatgtggtttcacctcaccccagccagaacagcttcatacagaaatcaacaaacaacaaatgctgatgaggatgtgtggaaaaaggtgccctaatccactgttggtaggaatgcaaactggtaaagccaccatggaagacagtatagagatacctcaagactctgaatatagacctactatatgatccatgaacccccctcctgggaatttacccaggggaaatgaattcactacccaaagtaagttatctgtacctccgtgtttattgcaaccaattcaaaataactaagaaatggaatcaacctaaatgcccatcaaccaaaaactggataaagaaattatgggatatttatacctggaataatacacagtggtaaaaacaatgaaatccagttatttgcaacacaatggatgaatcaagaaaagctcatacttggtgaaataagccagtcccaaagggacaaataccacatgttcttcctgataggtgagaactaacagagaacctaaaaggaaatctagagaagtgaaatagatactttaagaatggataactagaactgcccttgtcttaactgtcgaggaacaggttttttttgtttgtttggtttttggtttttggttatttttcttcctactattttttgaacttttacttaacatagagtcaatcatacgtgcatacactccattgaaaattgatcccagtaaaaaataaggatggaaataagcatgggaggaggaatttggtaactgcaaagctgtatagttctgcatactttcctacagacttacttctgagggtgcagtttaaaaacatgagtgggactccaagtcccaatagcttagtggtaaaaacgtcatcataattgttaaagtgatcatattaagtgttaacatgaagatttagataggataaattgtgaaagtgatcatataaataggatcaatgccttgtaataatataaatagaattataaaggacagaaagttccaacatgggaagaagtccacacagcagactcattgaatgacaatcgctttaagtaacactctgacctcagaatcagcccttaagtcaacctagtctggctgaaaagccgtgatagcatttcaggcatggaaatctaagacactgtggcaaaaatgttctgcctaaaggatctctgtaagtgagaacccaggggaaagaagtggcctcaaagaaggaggtacttttctctaaagcgagaagcaaatttccactttacttatggtcttgtccaaatactgacagtttgtggactcagaaggcttccatagcctaagcagctcatgtcaagagtctcaggtggtcactgacatcatatgtaagagtgtttattgttaaattaacaacaggtctcactgtgcactaactccccatgcaggacctccatcctcaatgagttctattatgagagttaactgtaaaaccagttctcaaacagttcttgtatttgtgtgtgtgtttaaatctttacatagtatagagttggtcttctgtgtacaaagttaattgaaaataaatcttaacggagtatgggaatggcaatgtcagaggaggaggaggaggggtgagagagtggatgggagggtgggaatgctgggaagaatcactatattcctaaggctgtatgtgtgaaatttgtattccttaaaaaataaattttaaaaaattaaaaattaaaaaacaataatattgttatgttcctaaatattctccaagattttaaaagatttgttgatactacatatggaatatttaagaaaaaagttttattatttattcaaagtcagtgttacacagagagagggaaagacacagagacaagttctcccatctgctggttcatcccccagatgacagtgacaccaagagacaggagtttcttcggggtctcccacgtgggtgcaggggccaaatactaggaccatgcttttctgctctcccaggtgcatcagcaagagatgattggaagtgccacagctggaacaggaacacacagcactatgggatgcaggcatcataggcagtggattcacctgctgcaccacagtgatgctttctccatttctgcgcattcattctcagtgtacaaatgcagcaccgatgtttcataaatggcacctagtggtggagtatattattatccatcatttcttgcacgtgctgtgagccctgcaattggcagtttgttactgctagaactttccccctttcacaacattccatcatggccaccaggacccagtgcttacatcaaggaacacacaacaccaacttcttatcctgcgtgtgagcttccacacatgagaaacacaagaggcacccatccttcatgccctggctgatgtcactaggcacaatgacctgcatcaaaacaaagatgtcctgaaatcataactgtacagaatcatggaaagaatcatatgttctgtgtcgttacctgtgctaccaaacaccaggggacactgcgctctgccagatacctgtgctctctgaagtgcacaaccccatgcctgctatacaggggcagcacatgcaaataaggcctccctctgcccatgaaaaccagcccagcactcaccctgcagctctggcacaggagctccagccccaggactcccaggtgtccactcagtgatcacactcaacacagatgctcaccatggagactgggctgcgctggcttctcctggtcgctgtgctcaaaggtaatgatggagaacacggggcactgagtctgggagaggacgtgagtgagaaacacagagagtgtgagtgacagtgtcctgaccaggacgtatgtgtttgcagg

SEQ ID NO: 11 - DNA, 10615 bp, Oryctolagus cuniculus
gacacagtgaggggccctcaggctgagcccggacacaaacttccctgcagggatgcacggttccaccagggagtgcacacaatgcattaagctcagaatatggtcctgcacaggtgcagagggaaattaagccctggttacctgtcaaggaattggggtttcctctcctacagttctgagggaagacttctacttttatgattctgtccccgccactgacttcactgacatagagaagtttgatgtgacaggatgaagtcctatatgaacaaattcaggttcgtgaacgatgacagtggtgaccagggtcagagatgtgggactctctgaggacctcatgagtgtgttcaagtctgactcaggacagtgccctcaaacactgccgactttaggacaattttagttttcccttaaaactcagagagagctgagccagagacttgatttgttaacctcaattatatatgtcatcaaactgctcctgtcagagtagcctgtgtgctaaaatgaaccaaccatcttattttaaaaggtggctgttccataggttccacagtctttataaccgatctccatttttcctttaatcctgaaacagtctgtggtcctgtttgaacgtcacagcactcaggaatgtacttgcagctcagctgtgtctgaggctgagcttctgtaggcacctgggaagcctacagggacttcctcatcctctaggtcctgggaccctcctgtgggctccctgcctgaactcagaagggaaatgcactggacaatagcagtcaaggtcataactgaatggaaagtgttgggtgtgcacttccagctgatctggttctgctccagtgtcgtgggaccccctgcacctgctgtggttcagcagagcagaaagtgggacacacagtggctgtgcactctggggctggagtccgcatcagggggagctgtgtctgtggctccagcatgatgcccagtgtcctgaggctgaatcacagctgcaggaagagccagtcccagcgaccatgtgtccagagtccctgctcttcactccgtgtctatgctcactggcattatcaatccatttgcagtcttatatcagttttagagagggagacacccaggctgcatatcagagtcctggacagagcccatttacacatttcccacacttgtactgacaatgcaccctggaagacagtaggtgatgattcagttttagagaacagaattttcactatttgccattcttccctttcctgtcatgactgtttgatgaataataagtgaatatagacatatgaggtacaatgatatgtgttgaaaaatgaatgtatcaaattgagtggaattttgaagtcagatttattgacatgctcatcgcaaaacgcactgtcactcccccacttacggaggaacgacaccggaccttgcactgttgtctttgcccggcccttcctgggtttgctgccgctcccccctgcttccaggaaggagcagcacacgccggctggctctctcaggggttgctcagatgttcctcctgcatgttgtctctctctcctcctttaaagtcctcttccaccaatcccaactctgctggcgttctctccccacacgctgagcacgctgctctcctccaatcaggagcgggatcagcttctgcagcttgttagtcgaattggtgaggcagctgtgttgtagttgtttactccctctcagcgccatatggtgggagatcagatgcatagaattagtcttagcaattccagtaatttagtctagtctcggttgctccccacacgcacatgtctcatgtagaatggcatctgtctcctgttttggaattctgtagttacaatattcccttaactgctgtcaccatgctgtacagcagatccctcaacgtgtggatcctgctggcctgaagctctgtccttcttactctttactgccatataaacttcctgttaaagtataaccctttccacttgtcccattatccattccatcttcagtggaaatttcactggattatatgtgtgagctctcgtgaattatgctgcattaattgtacatggaactgcagaggtgtttgccacagtggctgtggatcccctggacacctctctgggacttcatgtttcttctaccaggcaacagtgtttgaggatcctgtgataatgtatttctcagcttttgatgttttccatggaagctttactaacttacctgactccagccttgtaccagggttttcttctctctcttcctgcacaagacttgtcagctctggtatgtctgatgatactcagtctaccaggaggggtgggctgtctcgttgtgcttctaacatggacatgcatgatgatctcagatttaaagcatttttatacatttgcctttgtatattttcttcaaaaaattacagatatacttttacctcttttaaaacttgtatgtgtttatttgtccaaaaagacaaagaaacagagactgacagagagtgatctactgaatcctgggtaacttcccagatgcccataaaagctggattcggtcagatcacagccaggtgcatgatttcagtgcaggtctcacacatgggattacctcagacttttcgtactgcctcccagagtgcacattggcaagagtctgaaatagacccaaaatttggacataaacctaagcatcctgaaacgggaggcaggaatcccatgtgataccttcaaggccagtcctgtcacccaccttatcagtaactacattttttttagacaggcagagttagacagtgagagagagagagacagagagaaaggtcttccctccattggttcaccccgcaaatggccactacagccagcgtgctgtgccgatctgaagccaggagccaggcgcctcctcccagtctctcatgcgggtgcagggcccaagctcttgggccatcctacactgtcttccctggccacagcagagagctggactggaagaggagcaaccgggacagaatctgacactccgaccgggactagaacccggaatgccggaacagcaggtggaggagtagcctagtgagctgcatcgccggccaatcagtcactacatttaaacaattgatttcttcccttgtgattcagttgtaagatgtcattcaacatttggatctaggctcctaagcatatgtgtaagtatctgtcatttactttaaataccttttatttcaaaggcagtttatagcaagagagaaacacccaaagagatgaagagagaatcttccatccactggtttccttcctgaatggctgcaaaggctggaaatggctgaggctgaagccaggacccaggaacattctctaggtttcccacatggcttgaaggggacaaacacttgggtcacctttgacccaggtccattagtagggagctggatttgaagtggagcaagcagaatcgaacccatgctcctgtgtgatgcatgcatagtaggtatggcagcttaacctgcagggccacaacattggcccccatgggtgtgatcggaaaatactttctgcccaactgcaggtgactcctggttcttcaatcactctctttgttacacaggagctctgtagttggatccattatcttttgcctatttttgcttggttgcctgtactttggagattatcaaaatgtcattgcccaaaccaatgtcagcttgcttttgtccagtgttttcttctagaactttacagtctcaggtcttgctttttaggtatttttcaagctcactctgtttctgtatctggtgcgagatgaccacataattgaattattttcaagtgcattcaagtttccccaaccccatgtatgacagaatacccatcccccattctgtgtgtggcaccatgcatgcaatcagttttctgagaatgtgtttttttatttctacgtttctgttgtgctccatggctgtgggtgtctatgttatcccagcaccaggtctgatttcagctcagctaggatgaagcctcctgctttgctatttttctcaagactgttcagtcatcattaccctgaaattttcttgtgaattccagaattttattcctcttcctgtgaagaatacagggtgtttgacaggaaatgcattgaatctgtgaatcacatggtagcttggctattttagcaagatcattttttcataccacaactatgtcattaaaatgtacaggtaatcttcagattccttttcactttttatttatttttatttttatttttttgacaggcagagtggacagtgagagagagagagacagagagaaaggtcttcctttgccgttggctcaccctccaatggccacctcggcaggcgtgctgtggccagcacactgtgctgatccaatggcaggagccaggtgcttctcctggtctcccatggggtgcagggcccaaggacttgagccatcttccactgtactccctggaaacagcagaaagctggcctggaagaggggcaaccgggacagaatccggcgccctgaccgggaatagatcccggtgtgtcggcactgcaagacagaggattggcctagtgagccacggtgccggctaaggcccctatcttacaccttatacaaaaatccactcaacaaggattaaagataaacacctatgttcccacaccatccaattagtagagaacattagggaagccctcaagacactggcacacgttaagagttcttggaaaagacctcagagacataggaagtcaaagccaaaattaataaatgggattagatcaaatcgggaattctctgtgtggtaaaagaaacactcaggcaagtgaagaggcatctgacagcatgtgcgaaattatttgcaagctatgcaacggatatggattaataaccagaatttacaaagagatgaagaaattccaaaaacaaaacaaacaacccagttaagagatgggccaaggacttacacatttttcaaaagaggaagtccaaatggccaacacagacacatgaaaaaatgttcagcatcactagctgtcagggaaatgcaaatcaaaccacaaggagatttcacatcaccccagctagaatggcttcatacggaaatcaacaaacatcaaatgctggcgaggttgtggggaaaggtgcctgaatccactgttggtgggaatgcaaactggtaaagccactatggaagacactatggagatatctcaaaaatctgaatatagtcctaccttatatgacccaggaatccccctcctgggaacttacccaagggaaatgaattcactacacacaagagatacctgtacctccatgcttattgcagctctattcacaatagctaagatatggattcaaactaaatgctcatcaaccaaaaactggataaagaaattatgggatgtgtacactatggaatactacacagtagtaaaaacaataagatccggttattcacaacacaatgcatgaatctggaaaagatcatactttgtgaaaaaggccagtaccccggggacaaataccacatgttcttcctgataggtgagacctaatagagcacccaaaaggaaacctaggtaagtgaaattgacacttcaagaagggaagacttgagcttcccttctcttgtctgtgaagggacagttttttgtttgtttgttttttgtttgtttgtttatttttcttcctactatttgttgaagaatttatgtaacattcagtccatcatatgcacatacagtcaattgaaacttgatctcagtaaaaaataggaatgggagtaagagcaggaggaggaattttttaactgtaaagtgcatacattcctatggacttacttctaaacacacaatttaaaattttgttgtgggactccaagtcccatgaaacttaattaaagtgatcacattaagtgtaaggtgaacacatagataggattaagtgttaaagtgatcatataaataggatcaagtgcctggtaataagaagagatagaatttaaaaggagagaatgttacaacatgaggagaagtctacacagcagactcatagaatgataaccgctttaagtaacactctgacctgataatcagcccttaagacttcctggtctggctgaaaagcccatgagaacatttcaggcatgaaatccaagacactgtggcaaaaatgttctgcctaaaggatctctgtgactgagacctcaggcagtagaagtggcctcaaagaaggaggtacttttctctaaagggaggagagaacttccactttgctcatggccttgtccaaatactatcagagtttgtggactcaaaaggcttccatagcctaagcagctcatgtcaagagtctcaggtggtcactgacatcatacgtaagaatgtttattgttaaattaacaactggtctcactgtgcactaactccccatgcaggacctccatcctcaatgagttctattatgagagttaactgtaaaccagttctcaaacagttcttggataagtgtgtgtgtgtgtgtgtgtgtgtgtgtgtgtgtgtctgtgtgtttaaatctttacatagtacagagctggttttctgtgtagcaatacaagtgaatcttgatgatgaatcttgatcttgaatctgtgtaccaacttaaagtgaatcttattggaaaactgaactgacaagtggagagggatgagaaaggtggtgggaatgtaagtgggagggcagaaatgctgggaagaatatctatattcctaaagttgtactatgacattttttattccttaaaaataaattttaaaaaataaaaaataaattcaaaattgaaaaacaataatattgttatgtggacatcattcagcctgttgataaatttcctccaggactttaaaagtttgttgatactacatatgcaatcttttagaaaagatttatttatttattgaaagtcagtgttacacacagagagggaaagacccagagacaaattctcccatctgctggtttactcccccaaatgacattgacacctagagccaggagtttcttcctagtccccacctgggtgcagaggcccaatcacttggaccatgcttgtctgttttcccaggtgcatcaacaagagatgattggaagtgctgctggaataagaacagacagcagtatgggatgtaggcatcacaggcggaagattcacatgctaaaccactgtgatgttttctccattttctgcaaatttgttctcagtgtataaatgcaccagtgatttttcataaatggcatgtagtagtggagtatatttttctccattatttgttgcacgtgctgtgagccctgtagttggcagtttgtttctgttagtagtctcctgcaaagcctgtggattcacactctaaccatgcaatggactgggtccgccaggctccagggaaggggctggagtggatcgcagctaatagttataatggtggtagcatatattatgtaaactccgtgaatggccgattcatgttctccagaaacaacgcccagagcacagatttattgacaagctcatcagaaaaccctatgtttccatggtagaatggcatttgtctcctgttttggaattccacagacacaatattcccttcactgctgtcaccatcctgtgcaatagatcactgaatgtgtggaccctgtcaggctgaaactctgaccttgaacagcgtctcctctgctcctccctcgctcagactttggtctcaccattgtatcctgcctctgtgagttcatcctttttatctcatgtaaccagcatctcatattatttgtcttcttggccttgatggttttcagagtgtacttatcctgacacattatccttggacattattctctaggatcatccaagttgtccaaaatacagaatttcttccactttactgccatataaactcctggtaaaatgtagctttgtacatttgttccattgttgattctttcttccatgaaaattccatggattatatgtgtgaactattgagattggcgctgctttaattgaacatggaacagcagatgtctttgccacagtgactgtggatccactggacacctccagggatatcatattccttctacccagaaatggtgtttgtagatcctgtggtaattgtacttgtcagtttttgacgattttccataacattttgactaattttcctgaccccagccttgtcccagggttgtcgtctcactctgcctccccaagaattgtcagccttggattgtctgataattctcattctacccggagggatgggatgtctcattgtgcttctaacagggatatgcatgctgttcccaggtttacagcattttgtatgtttccctttatataacatctttaaaagtttatagatattttttcacttattttaaaatgtgtatgtatgtatgtgcccaaaaagagactgagactgacagtgatcttccaatgcctggtcacttctccgattgctacaaaagattcagctgggtcaggtgacagccaggtgcttggaattctgtccaggtgtccacatggcagtacttggaacttcacctatggcctctcagagtgtgcttaggcaggaaactgaaactggaaccaaactaggacacagcactcagcatcctgacaggggaggcaggaatcccacaggctcactccagtgctgctcctgtcaccaccttatcatcactgcatttaaacaattgatttcttcccttgggattcagttgcttgagatcattcaacattagcaaataggctcctaatcatatgtataattaatcttcaattattttaagtatctatttattttaaagtcagtgttatagcaagagaggaagagaccaacagatagagaatttcaatccgtggcttcacttcctgaatggttgcaatgttggggctgcaaaagcatgaagtcaggagcctggaacttcctgcagtttcccacagggctggaaggagacaaacacttgggtcatggtacacagtgatctccattgcactctctacctctgtgagttcaagcttgtggactgcatatataactaatgtcacatactatgtgtccacatgtacctgcattatttgttagcatattatgctcaaggctgaccaatgatttcctaatgacagagcaacctccttcttaacactgagtaatactccatgtcaaatgtaacagactgcattcactgttttatgcacatttcactttattgtagactgaactattgtgaacacagctgcattacctgaacccaggactgtgggtgaattgtgacacagtgacttctatccatggttagatggttacagaacagggaagagggggaacacaggggatggctgatagcagggcacaaagcaccactcaaagcaaggaataattctgcccccaccacagtgggctgactcagttcactacaacccacgacatgttccacaaataagcagtactgaggacacccagtctcccaatacaaagtgatggaacggaggtagaaatgtgaatgacagtgagttgatctgtgcccatttctacaacacacagattccaatagcacactacacaccactaacacatacagtgttctgtgttaatgaacagttttcaaataaggtaatggatgaataaggaaacaagacatagtatccttaaatgaatccacttgcagtctttcatctgtgtaaatatgggcggcaggcattaggagaaaattggcaatgtccccactaggaacacccgtgttcccatcagagtgctgcttgagcccagccacacggcttcctacactttttcctgataacacatcatggtaaactagagatgatgctatagcgatagagcccctacaaccgacaaaggaaacacagacgcagttctgggctccaggttttagaaaggctaactcctagatgttgtaggcattttgggagtttggggctgtcaattcaaaggcagaaatctcccattttcatcttttctgtccatcactacacttgtgtttctctcaccccttctctctatcactattccaatgtctttcatatcgatgatagagaggtcaatagatgatatgaaacaattgttattttaaaaatgaaggacatgatattgcaaacactggatactaagggtacacacatactaaaatgaaaaaacaataaaacataaaaaattcatatgatccaaatcctatcatagcctacacccacaggacatgtacatctgccctgggccctgtcctgtctgagacgtctactccagggctggctatataggggcagctcatgcaaatagggcctccctctgcccatgaaaaccagcccagccctcaccctgcagctctggcacaggagctccagccccaggactccagggttccactcagtgatcgcactcaacacagacgctcaccatggagactgggctgcgctgggttctcctggtcgctgtgctcaaaggtaatgatgaggaacgcgcggcactgagtctgggagaggacgtgagtgagagacacagagagtgtgagtgagagtgtcctgaccaggacatctgtgtttgcagg

SEQ ID NO: 12 - DNA, 6218 bp, Oryctolagus cuniculus
gacacagtgagggccctcaggatgagcccagacacaaacctgcctgcaggagcacgcaccgccaccagggggcgcacaagacgcactgagcagactcagacccattcccagatgtggtgggaggtgaattccaggtcctcctgaggaaattggggtttgtggtcctgtaactgtttcctacgttccgatctggaaggatgattctgtccctaacaccgatcactgaacagaagttttggtatcacgggaagatgtcacatgatggagtcgtttctggaagaatgaatgacatctttggagtccccagcatctgagacctgagtaagctctgggcacccggggagtcttttcctgtccaaatcaaagaggagctctccgtggaattctctgatgacgtcatctgggaccctgctgagagcccaggggcagtgtggagccggtcaggggctatggatgctgcagtgtttcacatccatgccctcccctcctgcacagctgggcccccgagggacagagctgaccccgtggtcctggtccctggggctcccatgtccattctctgcagctgtgccctcgtctccctttcacttcctcaccctgaactcacaggttgaggtccacatggtccaaaccccaggtcagggataaacctgcagttcaggggtggctcaggctgtggctcctagaaatcctgcttgctcttcctcactcacgtctcctgggatccccggacctgctctcatttgcaagcagaggtggccgttggtagtgcaaggggtcagactcatggaaaacactgggtgtggagaggtcttgttccccacactctgctggccttgtctccatctcagggagaccagcaggtgggaaagcccagtgaagtctgcactagagtccaggtggttctggactgtgtccctgtgagcccaccaatgatccaaccctggagctgcatccctgctgcatgaagggcctgccccagagactgtgtgtccagagacccccgactccttcctccagggactgcctgcacctgttctcagccatgctcctccttctgtggaagcaaaattgtccttcaaatctcaactttatcatcatcaggaatgaacaaattttctgctcttcaccaggataactgcatcaaccccatgtgtttacaaaatgtctcctgcaaaaatgcaattgttctctcatgtaggattcttacagaaactgaagcaattctctcagctgaagtagaaatgactaatttggagtggctctgtctaaatttggagacaaaggagagactctgtttcaggtgggaacagatgagtggctagtatgttgctatgcacctgtttttttttttttttttcccgcatgttggttccaaatgtagtaccccagaggggaggtgtgtggagctcacagccatagaggctgacgtccaggatcagacagtgagaatgttgtgccatcaggcatgctaatattgtgaacatcatacagtgttcaggcatcctaatattgtgaacagggatgggagggaccccatccccacacaggacatcagatgagaccagggctgactctagaagcactgtgttctgtgctgaagctggggacccaggagatctactgtgatctcctccaagagcagattccccagaaatgaacaaatcccactaggcctcactcgcagagctcccccacttctcccacagtcaccctggaatgactccaaaacacacacacctttgaggacacactctgccacaggcagaggagggaggtttccttccacacgcattgtaggcctgatgacacagaacctgttgttcaggatgaagccagttgtgtaaaacaggtattttgagacgttagaagactcagggtcagttttaaacacagctcatgcagacagtccttttgttcctttgggatacaggctactgatcatacgttctatatgaaaatagttacttccatgtgtgtgtaggctgctcacttctcatcggtccacttgcagtagagaagctctgtagtttatgtagcatcttctgaaaaggttttcttgcgttgcctgaactttggagatctaaaagggaaatcatggacagaccactatcagggagattctgccctatatttccttccagtagttgtacaatggactttacatctgatgtcagatcctgttattccatgcttttcatgtaaacatccagatcgtgcacccgctgtcagtgctgttatgttggggccatgctcagcactgatgctgtgaggacaaaccacatccaccaccagcaggctgctcccagcattctgtgtggttctgttaggggcactggggacctcagcttcctccatgaggccctgacattgaatccactcatggtgggagtcgtcactggatgcactccccagaggcgacaccattccacatctcccaggcacctgtgctagttttactcagtggtggtcagtgtgggggtccctggggtaaggagacctgatcagaactcctgactctgtgctctcctgcaggcactgggtcccagcagtgtggcccttccacctgtccttaccctcctgcagaggaagagcccacacctccaccaggtcctttctctctatgttgctggaccctgtccccgactgtcacttccccacgtgccatggttctcctccccagtcctcagctttgggggtggagccatcccctgaagatgcagacttctgtgtcttgggggatcagtgctggcacagtgtctggggtggactctgctcacgaacattttctacaggatcccaccaggacattggtcatgatggtttcctcctgcaggtgaatcactttcttactcagtggacacagaggagcagggtctggggtatggaggctgaggatgctgttcctgcagagccgtgagcagagccagcactgcttggtgtgtgtgtgtggtctctccaactgagcagctgaaggctgtatgttaggtggaacttaccctccatacttgatgcacggagcctcccatcatgcatgtggggacctcaccacccagtgatcccattgagaggggctctagggaggggacaagtccatgaaggttctgcctgcattgaagggactatgaaccttagagagaccctcccatacatttgtggttcctggggctgcaggaacaggaatctggtattgggtgccagagtcacatgtgagacccttgcactcccttgggggaggtgcacatcttaaacaatgcaactttcattttattatttatcttatatccatgaaatttgataacagagttaagattaatgcgctgcacatttgtgccaaatacaatatacttactctaatttatttcagttttactcttatcagattttcagatattttggttaaaaactaataaaccctcattcacctgtgccctacaggacctgcaaactcagtgccttcaacttctgcccctggcaaacctacatgatgctcagcactgaactggatgtaatctgttgtgaaggagcccaaaagggctcaggccttaatgtgactggaggaggtgggccagggcagggtgacacaggagcagtggacagcactgtgggatgtcatatttcctcttggcatagttgtgatgaagagtgagagaggcacaggtgagtcgcactcaccacacactttcaacatgtggggctgcctctgtatctatcacaactcgacagcattgggaagcaaattgcccagcagagaaattgtgaagaacagacagacagacaccagcacgtggaacaccacactgatatgcacctgcatgaaacctggtcccctgtgcatctctctgtcaaaaacagaatccagccaaagtgctccatgttcatgaactaacttgtgaatgaggtcactgtagttggagatgggactgcaaatgtctagacatggcgccctcagatcgcttggacacatccctcagacttcgtattccctgtaagcaacagcaggatttggcaatttttaaaaaagatttattttatttactttatttatttaaatgacagagttacagagagaggtagatacacacagagagaggtcttccatccactggttctctctccagttggtcacaatggccaaaattgttccgatccgaaggcaagggccaggagcttcttggggtctcccacgtaagtgcaggggcccaaagacttggtccctcttctactgcttcccaggccatagcagagagctggatgggaagaggagcagacaggactggacaggcgatcatttgagatgctggcgcttcaggccagggctttaacccaatgtgccacacaccagctaaagtatgagactggtgaacttttggggcgggagttcatggactggcacttttttgtccataactgatatttcattggtgttaatatccagcacacaggtgttttgatgtgtactcaattcttaacacacacacgaaaacctaaaaagccatgcattgctttttttaaaaaaagttattttaatgaaattctacttcaaatttggaagaaacacattcatgtgccactatcttcaaagactactcttacataaatcctacccagtcacaatttaacatcatatacacgaaaaactcactatttcaacccttcacagcacattaacaaattcattaggtaagctggacaaccaaaaccaatgacagtacagagcgcacattgctcctggagctgttaggtggagtggaaagtcctgtgtgaggaacagaggtgtagagtgtggaggtgcctcctaccagactagagccccaggacacagcacagcctgtctgtgattccttcagtaactctgcacgtgttcaagggaggtatccctcatgccagtatcacatttctgtgcttgtgcagacacaacacaggggcaggcactgttgtgcagtgagttgagcccttgttgggagcccacaccctgtgttggagtgatggctcaagaaccagcctctccacctcaggccctgtgtccggagggtgaaaatgtaaaggtggggccagtgctgggacatagtatgttgcagaccaaatctgcagtactggtgtcccacatgtgcaccagttcaagtcccagctgctctacttccaatccagctcactgctacagccagggaaagcagtagaagacagcgcaagtccttggttccttgtacctgtatggggatctggaagaagctcctggctcctagcttccaagtcgctaaggtctagctgttgtgactaattggaaagtgaaccagaggaaagacgattgtgctctctctctctgtgtctctctccatctctctctctctctctctcactctctctctctctctctctgcctctagttctctctgtgtgtaactttgactttcaaataaataaataaatgttcaaaatataaattaagggcccgagccagggctcacttggctaatcctctctctgcggtgccggcatcccatacaggtgccaggttctagtcccagttgctcctcttccagtccagctctgagctgtggcccaggagggcagtggaggatggcccaggttcttgtgcccctgcactcacatgggagaccaggaagaagcacctggctcatctcttcggattggaacagcgctggctgtagctgccatttggggagggaataaacagaaggaagacctttctctctgtgtctctctctcactgtctataactctacctccaaataaataaatatatatttatataaattttaaaaagatgaatgaaatgcttttctgtccattatctcacaacaatttccaggtctcatggcattaatcggctacttaagatgccagacaccctcgtctgccctgggccctgtcctgtctgaggcatctgaccccatgcctgctatctaggggcagcacatgcaaatagggctccctctgcccatgaaaataagcccagcgctcaccctgcagctctggcacaggagtaccagccccagcactcccaggtgtccactcagtgatcacactgaacacagacgctcaccatggagactgggctgcgctggcttctcctggtcgctgtgctcaaaggtaatgatggagaacgtggggcactgagtctatgagaggatgtgagtgagagacacagagagtgtgagtgacagtgccctgaccaggatgtctgtgtttgcagg

SEQ ID NO: 13 - DNA, 2804 bp, Oryctolagus cuniculus
gacacagtgagggtcctcaggctgagcccagacacaaacctccctgcagggacgtgaggctctaccaggggggcacaagatacactgaaccaagattcgggtcctgcacaggtgcagagggagatgaagcccttgtttcaggtcagggaattgaggtttcctctcctttaacacttttcagggaataattctactttttttgtttctgactgactgcagattccgtggacacctccctgggatttcatattcattgtaccatccaatggtgtttgaagatcatgtaataattgtttctcgtttttgatgcttttccatatggttttactaattaacctgacacagacttgtaccagggttatcatctctctctacctccataaaacatgtcagctctggtatgtctgataatagccattctaacaggagcgatgcgatgtctcaatgtgcttctaacatggacatacatgatggtcccaaattgatagcattttatatgtctgtctatatatcttcttttaataatttatagaaatgatataaattttaaaatttatcattttatttgagaacttgtctttatgtatttgtccaaaaccacagagagcctgagactgacagtgatcttctaattcctgcgtcacttcccagatggctacaaaagattcagctgggtcaggtgacagccaggtgcttgtaattctgtccaggtctcccatgtgggactacttggaacctcatctacagcctcccagggtgtgcttaggcaggaatctgaaactggaaccaaagtaggacgcagcactaagcatcctgatacaggagcaggaatccctcaggataactccagtgctgctcctgtcaccaccttatcatcactgcatgtacacaattgatttcttcccttgggattcagttgcttgagatctttgaacattaggaaacaggcccctaatcatatgtataattattcttcaatgtattttaagtatctatttattttattttaaagacagtgttatagcaacagaggaagagacaaacagatggagggagaatcttccttccacaggtttccttcatgaatgtctctaagactggagatggctcagcctaaagtcaggagcctggaacttcctccagattcccacagggctggaaggtggcaaacccttgggtcatggttgacagtgatcaccattgcacttcctacctctgtgagttcaagcgtgtggactgcatatataactaatgtcacatactgtgtgtccacatgtacctggatcatttattttagtatttatgctccaggttgacccacatttcctaatgacagaacaacctccttcttaatactgaataatattccatgtccaaatgggaaagaatccattcactgttttatgcacacttgatctttgttgactgaactattgtgagcaaagctacaacctgaacccaggactgcagatgaattgtgacacagtgacttctacccagtgcttggcctcaactcagagtcatggttacagaacagggaagagtggggaacaggggacggctgataccaggacacaaagcaccaccaaaggcaggaataattctgcccacaccacagtgggctgactcagttcaccacaacccatgacaggttccacaaataactagaactgaggtctccaggcctcccaacagagtgatgggaaggaggtggaaatgtgcatgacactgagttcatctgtgcccatttctaccatgcacattccagtagcacacaaaccccactaccatgtacagtgttctgtgttcaggaacagttttaaacagtttaaatagtttttaaactttaaggcaatggatgaataaggaaacaaaacatagttaaccttaaaaaaatacacttgcagtccttcatctgtttaaaagtgggcgacaggcattaggacaaaattggctaagtccccactagggacacccgtgttcccatcagagaactgactgagtccagcctcacggcttcccacacttttccctcataatgcatcatgggaaactgtagatgatgctacaagcaaaggagcccctaccaccgacgtttgaattacagacacagtttcttgcttcagggttcagaaagactaactcctaggggtcataggtatttgggatgtctggggctgtcaacccaaaggcagaaatctcccattgtcaacttttctgtccatctctacatttctgtctctctcaactcttctctctctatcactgtacaaatgtctttcatatagatgataaagaactaatggttatttaaataaatgagggacatgatattgctagcactggatattaagggtacacacatattagaatgaaacaaggtcattgccttcaatcttttaaaattatgataacataaacattcacatgatctgaatcatatcatagccatcagcctacaaacctaggacaccacgtctgccctgggccctgtcctatctgaggcatctgaccccatgcctgctatctaggggcagcacatgcaaatagggctccctctgcccatgaaaaccagcccagtcctcaccctgcagctctggcacaggagctccagccccaggactcagtgatcgcactgaacacagacactcaccatggagactgggctgcactggcttctcctggtcgctctgctcaaaggtaatgatggagaacgtggggcactgagtctgtgagaggacgtgagtgagaaacacagagagtgtgagtgacagcttcctgaccaggacgtctgtgtttgcagg

SEQ ID NO: 14 - DNA, 1981 bp, Oryctolagus cuniculus
aacacagtgaggagccctcacattgagccaaaacaccaaactcctgcaggggcccgcggctccaccagggggcgcacaagacgcactgagcgcagattctggtcctgcacaggcgcagagggagatgaagtcctggtttcctgtcaggaattggggtttgctctcctgtaacagttttgagggaagaattctacttttcaattctgtcccttccaacttcaatgacggggagaaactttgatgtaaaaggaagaagtcctaattgaacgatttagtacatggacagcgaatgtgctcaccaggatcagagatgtgggaatattgaggacactattgaatctcttccaacctgactccggacagtaccctcagggcactgaaatctttggacagtttcagttttccctgcataaccagggacagctgagacagggtcgttgatctgttaaacagcaactattccgctcatccctctcctgccacaaccagcaagtgtgcactgaaccaacctttgactctacatgagggtgatccacactcactttctgcagactttaacccgacctgcatttcccctttaatcctggaacagtctgtggtccctgtgtgaacatcacagcactcaggaatgtactgcagctcagctgtgtctcaggctgaggttctgcaggcacctgggaaacctacagggacttcctcatcctctaggtcctggtaccctcctgtgggctccctgcctgaactcaggagggaaatgcactggacatcagcagtcaaggtcatcacagaatggaaagtgttgggtgtgcacttccagtttatctggttctgctccagtgtcgtgtgaccccctgcacctgttgtggttgagggagagcagaaagtggaacacacagtggctgtgcactctggggctggagtccacatcacggggagctgtgtctgtggctccagcatgatgcccagtgtcctgaggctgaatcacagctgcaggaagagccagtcccagagaccatgtgtccagagtccctgctcttcactccatgtctatgctgactggcatcaacaatccatttggaggctttctttaatatacagagggagtcccccaggctgcatatcaaaattctggacacagcccatttgcacactttcccatacttgtactgacagtgcacctggaagacagtagatgatggatctgttatgaggccccatcaccaaggtgggaacactgatgcagttccatgctcttgggttccagctgccaagccttgagtgcactgccttcatttatcatctccataaaactttgggaagcacaacaccagcattttccgttttagccattttatttttataaatgtttgataaatattaatttgatatatacatatgaggtacaattatgtgttgtcattcttattgacatgttcatcacaaaatccacatgtttccatgctaggatgtctgttgtatcctgtttttttttttttttttttagagtggacagtgagagagagagtcagagagaaaggtcttcctttgccgttggttcgccctctaatggccaccgcggctggtgcgctgaggctggcacaccacgctgatcggaaggcagaagccaggttcttctcctggtctcacatgtgggtgcagggcccaaggacttgggccacccttcactgcactccctggccacagcagagagctggcctggaagagcggcaaccgggacagaatccagcgcccaaccgggaatagaacccagggtgctggcgctgcatgtggaggattagcctagtgagctgcggtgccggccagttgtctcctgttttggaattccgtagacccaatattcacttcactgctgtcaccatgctgtacagtagatgctcagtgtgtggatcctgtgggactgaaactctgaccttgctccaacgtcccctctgttccatgcccttttctttcaacatgcaat

SEQ ID NO: 15 - DNA, 10265 bp, Oryctolagus cuniculus
gacagagtgaaggccctcagggtgaacccagacacaaacctccctgctggggcacgtggctccacatgggggtgcacaagacgcaccgagagactcagacccaggaccagatgcagtgggaggtgaattgctggctccggtccggaaattggggtttgtggtcctctaaagctttcctacattccgatctggatggatgattctctccctaacaccgatcaccgagcagaagttttggtatcatgggaagacgtcacatgaagaaaatggagtcgtttctggaggaatgaatgacatctctggggtccccagcatctgagacctgagggagctctgggcacccagggaggcttttccagttagtaccatcatgcagtacccaagataggaggtgtatggagcaaaaaggtttatggagctcacagctgtagatgctggaagtccaggatcagagagtgagaatgtgtgccgtcaggcatcataatattgtgaacagcatggcagtcatcaggcattctattattgtgaacacggatgggagggaccccatccacacacaggacgtcagacgagaccagggctgactctagtagcactgtgctctgtgctgaagctggggacccaggatatctactgtgatctcctccatagcagattccccagaagtgaccaatctatttctgtaaacatccagaccatgcaccccctgccagtgctgttacgttggggctatgctcagcactgaagctgtgaggacaaaccacatccaccaccagcaggctgctcccagcattctgtgtggtcctgttcagggcactggagacctcagcttcctccatgaggccctgacgttgaatccactcatggtgggagtcgtcactggatgcactcccagagatgatgtcattccacgtctcccaggcacctgtgctagttttactcagtggtggtcagtgtgggggtccctggggtaaggagacctgatcagaactcctgactctgtgctctcctgcaggcactgggtcccagcagtgtggcccttccacctgtccttaccctcctgcagaggaagagcccacacctccaccaggtcctttctctctatgttgctggaccctgtccccgactgtcacttccccacgtgccatggttctcctccccagtcctcagctttgggggtggagccatcccctgaagatacagacttttgtgtcttgcgggatcagtgctggcacagtgtctggggtggactctgctcactaactttttctacaggatttcaccaggacatgggtcatgatggtttcctcctgcaggtgaatcactttcctactcagtggacacagaggagcagggtctggggtatggaggctgaggatgctgttcttgcagagccgtgagcagagccagcactgcttggtgtgtgtgtgtggtctctccaactgagcagctgaaggctgcacgttaggtggaacttaccctccatacttgatgcacggagcctcccatcatgcatgtggggacctcaccacccagtgatcccattgagaggggctctagggaggggacaaggccatgagggttgctgcctgcattgaagggaacaggacatttgaaagacccttcagtaactcaaggtttaactctcacacatgagtcagtaaggaaaagagagagatgctcccactcactgcactttctccaatgtcgctgtggccaggtctgcctcccagcctggcccagtttcaggacaacaatcatgtgcatccactagagtggcagggcccaaatatcttccataaatttctgattcctggggctgcaggagcaggaatctggtactgggactcagaaccacatatgagaacctggcactcccctgggtaatgtttgcatcttatacagtgcaactttcaatttattatttcctttatttccatgaaatttgatgacacagttaagactaatacactgcatatttttgcaaaatatcatattctcactctgctttacttttttttatttatttatttattttttattttttttgacaggcagagtggacagtgagagagagagacagagagaaaggtcttcctttgccgttggttcaccctccaatggccgccgcggccggcgcgctgcggccggcgcaccgcgctgatccgatggcaggagccaggagccaggtgcttttcctggtctcccatggggtgcagggcccaagcacctgggccatcctccactgcactccctggccacagcagagggctggcctggaagagggacaaccgggacagaatccggcgccccgaccgggactagaacccggtgtgccggcgccgcaaggcggaggattagcccagtgagccacggcgccggcccggatatgggtaaaaagcccatgagagtgtttcaggcatggaaagccaagacactctcgcaaaaaaaaacatgatctaaatgaaagatctctgtgagtgagatcccagcggaaaaaaaataggccatcaaagaaagacgtgcctttctctgaagggaggagagaacttccactttgactatgaccttgtctaaataagatcagagttggagaactcaaaaggcttctatagccttggcaactcgtgagaagagcctagggtgattactaacgccataaacaagagtgtcagttgttaagtcaataaaaggagtcactgtgcacttaactccccatgtagtatctctgtccttaatgtgttgtacaatgtgaattaatgctataacgagtactgaaatagtactttacactttgtgtttctgtgtgtgtgtaaactgttgaaatctttgcttaatatatactaaactgatcttcagtatataaagagaattgaaaatgaatcttgatgtgaaagggatgggagagggaaccgttcgacccagccatcccactccttggaatttacccaaaggtgtttaaattgtcaaacaaaaaagaggtctacaccctaatgtttattgcagcacaattcacaatagccaagacctggaaccaacttaaatgcccatcaatggtagactggataaagaaattatgggatatgtattctttagaatactataccgcagtaagaaacaatgaaatccagtcatttgcaacaaaatggaggaaactggaacacataatgctgagtgaagtaagccagtcccaaagggacaaataccatatgttctccctgatcagtgacaactgactgaacaccaaaaaggaaacctcctgaagtgaaatggacagtatgagaaacggtgacttgatcagcacagccctgattgttaatgaacaacttaatacattatccctcttagtatttttttgtctgttctacttaatatgactggtttaattctgtaattaatacacagtgattcttaagtgttgaaatttaactgaaatgtgatccctgttaaacataagagtggggataagagcgggaagagatgtatagtttgggacatgctcaagctgacctgccccaaatggtagagttagaaacataccaggggattccaattgaatcccatcaaggtggcatgtaccaatgccatctcactattccaagtgatcaatttcagttcacaatcgatcataatgaaaggactaagagtcaaagggagcacataaacaagtctagtacctgctaacactaaccgatagaataaataaaggggagggtgatccagcatgggaagcaagatactcagcagactcatagaatggcagatgtcctaaacagcactctggcctcagaatctgccctaaaggcattcggatctggctgaaaagcccatgagagtatttcaggcatggaaagccaagacactctggcaaaaagatctctgtgagtgagatcccagtggaaagaacaggtcttcaaaggaggaggtacctttctctgaagggaggagagaacctccactttgaatatgaccttgtctaaacaagataagagtcggagaactcagagggcttccatagccttggaaactcatgactgaagcatagggagattactgatgccatagacaggagtgtcaatttgtaaagtcaacaaaaggagtcactgtgcacttactcctcatgtaggatctctgtccttaatgtgctgttcattgagatttaatgctataacgagtactcaaacagtatatttcactttgtgtttctatgggggtgcaaactgttgaaatctttacttaatgcatactaaactgatcttctgtaaaaaaaaagaaagaaattatcaattcccaacttgtctctcactgggattaaacatgacaataggtctgatctgatttcatcatcatttaaaaaaaatctattatttttcactttatgtttcagtgtgggagcaaactgttgaaatccttacttaatgtatactaagctgatcttctgtatattaagataatcaaaaatgaatcttgatgtgaatggaaggggagagggagtgggaaaggggagggttgcgggtgggagggacggtatgggggggaagccattgtaatccgtaagtcgtactttggaaatttatattcattaaataaaagttaaaaaaaataaagaaacagaaaaaaaaggggatgggagagggagcaggagatgggagggttgcaggagggagggaagttatgagggggaaaagccactgtgatccaaaagcagtactttagaaatttatatttaataaataaaagttaaaaaataaatttaaaaaataaaaaagatttaaatattttaaataatattgttacatggacatcatgcatgctgttcctatatttcctccaaggttttaaaagatgttgaaactgcacatgcaattttttagaaaagatttatttatttactgaaagtcagtgttacacagagagagggaaagacacaaagacaagtcttccatctgctggttcatcccctagatgacagtgacaccaggagacaggagtttctttggggtctcccacgtgggtgcaggggccaaatactaggaccatgcttttctgctctcccaggtgcatcaacaagagacgattggaagtgccgcagctggaacaggaacacacagcactatgggatgcaggcatcacaggcagtggattcacctgctgcaccacagtgatgctttctccatttctgcacatttgttctcagtgtacaaatgcagcactgatgtttcctaaatggcacctagtggtggagtatattattctccatcatttcgtgcatgggctctcagccctgagcttggcagtttgtttttgttagaacttccctcttcatgatattccctcgctgccacccagacctagtgtctacatcagggaacacacaacaccaacttcttatcctgcatgtgaggttccacacatgagacacaagaggcacccgttgttcttgccctggctgatgtcactaggcacaaagacctgtatcaaaacaaagatgtcctgaaatcataactgtacagaatcatggaaagaatcatatgttctgtgtcgttacctgtgctactaaacaccagaggatgctgtgctctgccaggaacctgtcctatctgaagtgcacaaccccatgcctgctatacaggggcatatacaggagaacagtctgacagcagcggacatagccacctatttctgtgccagagacacagtgagggaccctcaggctgagtccagacacaaacctctctgcagggacacgcggatccaccaagaggcacacaagatgcactgaatatatattctggtcatgggtaggtgcagagggacaataagccctggtttcctgttagggaattggggtttcctctcctctaacacatttgaagaaatggttctactcttacgattctgtccctgccactgacttcactgacggatagaaactttgaatagaaggaagaagtcctatgtgacaatttcgggttcatgactgacaactgtccttaccgtgatcagatatcatggggatctgtgaggacctcgtgagccttttccagtctaactcgtgctggtgtcctcagggcactgccgactctaggaaaattttacttttccctttatatcctggagacagctgagccagggtctctggtctgttaaacctcaactatttccctctcttcctgtcaaagtagcctgtgtgcggaactgaactgacattttattttaaactgtgggtgatccacactcactttccgcagaatgtggccacctttaatcctgaaacagtctgtggtccctgtgtgaacgtcacagcactcagggatgtacttgcagctcagttgtgtctcagactgagcttctgcaagcacctgggaagcctacagggacttcctcatcctctaggtcctgggaccctcctgggggactccctgcatgaactcagaagggaaatgcactagacatcagcagtcaaggtcatcactgaatggaaagtgttgggtgtgcacttctagttgatctgattctgttgagtgttgtgggactccctgcacctgctgtgattcagggagagcagaaagtgggacacacagtggctgtgcactctggggctggagtccacatcacggggagctgtgtctgtggctccagcatgatgaccagtgtcctgacgctgaatcacaactgcaggaagagcaagtctcggagaccatgtgtgcagagtccctgctcttcactccatgtctatgctgactggggtcatcaatccatttggagacttccatcagtattagagacacccaggctgcatatcagagtgatggacacagcccatttgcacactttcccagactagtaactgacagtgcaccctggaagtcagtagatgatggatgtgttatgaggccccatcaccaaggtgggaacactgatgcagtttcaagctcctgggttccagctgccaagcttcagtccactggaatttatttatcatctccataaaatattggaaaatactggaaagcactacaccagtattcagagtgttgaatctccatttttgatcatttaatcatttcctttacataagtgtttgatatataataccaaaacatagacatatgaggtacaattatatctgttgataaataaatgtatcaaattgagtttttatgaagtcagacttattgacatgctcatcagaaaaccacgtttccatggtagaatgtcatttgtctcctgttttggaattctgtagacacaatattcccttcactgctgtgacgatgctgtacagtagatcctcagtgtgtggatcctgttggactggaactctgaccttgctccagcgtctcctctgctcctcccttgctcagacgttggtcttcaccatcgtacttcctgcctctgtgacttcatccttttatcccatgtatccagcatcacgtattatttgtcttcttgtcctgcatggttagcagagtgtacttaccctgacacattatccttggacattattctccaggatcatccgagttgtccaaaatacagaatttcctcatctgtactgccatataaacttcctgttaaatataattttgtccatttgttccattgttgattctttcttcatgaatatttcactggattgtatgtgtgaactcttgtgaatgatgctgcattagttgaacatggaagagcagaggtgtttgccacattgattgtggttcctctggacacctccctgggatttcatattccttctacccagaaatggtgtttgaagatcttgtgaaaattctatttctcagtttttgatgattttccataatagatttacttgtttacctgactccgatcttgtaccagagttatcgactctagcttcctccacatggattgtcagctctggattgtaggaaaatactcattctaacaggaaggatgggatgtctcattgtgcatctattagggacatgcatgatgggcccaatatatcattttatatgttgcctttatatcttttttaaaaagttaaagatactatttcacttattttgatatttgtatttacatattttttcaaaaaggcaaagagactgagactgacagtgatcttctaattcctggtcacttcccagatggctacaaaagcttcagcttggttaggtgacagccatgtgcttggaattctgtccaggtgtccacatggcagtacttggaacttcacctactgcctcccagaagggcttaggcaggaatctgacactggaatcaaactaggacacagcactcagcatcctgacacgggaggcagcaatccctcaggctcactccagtgctgctcctgtcaccaccttatcatcactgtatttaaggaattgattgcttcccttgggatcagtggcttgagttcattcaacatttggaaataggctcctaaccatatgtataattaatgtttcatttattttaagtatttattttatttgaaaggcagtgttatagcaagagataaagctatcaacagatggagagtgaagtttccattcactggttttcttcctgaatggctgcaatggctgggatgcctgagcctgaagccaggagcctggaacttcccccagtttcccacagagctggaagggaacaaacacttgggtcatggtagacagtgatcaccattgcacttcctgcccctgtgagttaaagcttgtggactgcatgtatactaatgtcacatgctatgtgtccacatctacctgcattatttctgttagcatattatgctccaggctgacccatgatttcctaacgacagaacaacctccttcttaacactgaataatattccatgtcaaatgtaacagactgcattcaccgttttaggcacatttcactttattgtagacagaactattgtgaacacagctgcattacctgaacccaggactgcgggtgaattgtgacacagtgacttctatccagtgcttgagctgaactcagagtcatggttactagacacagggaagagggggaacacagggcagctgataccagggcacaaagcactcacaggaaggaataattctgcccacactacagtgggctgactcagttcaccacaacccacgacagagtccatgaattatgagaactgaggtctccaggcccctccaactcagagtgtaggaaaggaggtggaaatgtgaatgacaatgagttgatctgtgcccatttctacaacacacagattccaatagcacacaaaccccactagcaagcacagtgttctgtgttcatgacgagtgttaaataagtcaatggatgaataaggaaacaaaacatagttaacctaaaaagaatccacttgcagtcttttatctgtttaaaagtgggaggcaggcattaggacaaaattggcaaagtccccactagggacacccgtgttcccatcagaatgaatcattcagccacacgacttcccacactttttctgataatgcattttggaaaactgtagatgacactacaagagaatgagcccctgccactgacgtgggaaacaaatttgcagttttgggctccaggttttagaaaggctaagtcctcggtgttgtaggcacttgggatgtttggggctgtcaatcaaaggtggaaatctccctttgtcaccttttctgtccatctctacatttctctttctctcaccccttctctcactgtcactattccaatgttattcaaatagttaaaaatgaaccaatggttatttaaaagtgaaggacatgctaacactggattattaaggatacacgcatattaaaatgaaacaaggtcattgccttcaattgtttaaacaacaataataatgtaaagatttctatgatctgaatcctatcatagccatcaacctacaccacaggacatcacatctgccctgggcactgtcctgtctgaggcgtctgaccccatgcctgctatataggggcagcacatgcaaatagggcccactctgcgcatgaaaccagcccagccctcaccctgcagctctggcacaggagttccagccccagcactcccaggtgtccactcagtgagcgcactcaacacagacgctcaccatggagactgggctgctctggcttctcctggtcactgtgctcaaaggtaatgatggggaatgcgggacactgagtctgggagaggacgtgagtgagagacacagagagtgtgagtgacagtgtcctgaccaggacgtctgtgtttgcagg

SEQ ID NO: 16 - DNA, 7213 bp, Oryctolagus cuniculus
gacacagtgagggaccctcaggctgagcccagacacaaacctccctgcaggggtgcgcgtctccaccagggggcgcacaacacacactgagcagactcaacccgcgcccagatgcagtgggaggtgaattgctgattccttcaggaaatttgggtttgctgtaaccgtttcctacgttccagttcttgatggatgattctgtccctaacagcgatcaccgagcagaagttttggtatcatggtaagatgtcacatgaagaaaatggagtcgttttgaaggaatgattgacatctctggggtccccagcatctgagacctgagggagctctgggcacacggggaggcttttcggggtctgagtctctggagtttgccccgtggtattctctgatgacgtcatctgggaccccgctgagagcccaggggcagtgtagagccggtcaggggctatggatgctgcagtgtttcacatccatgccctcccctcctgcacagatgggcccccgagggacagagctgaccccgtggtgctattccctggggctcccatgtccattctctgcagctgtgccctcgtctccttttcacttcctcaccctgaactcacaggttgaggtccacatggtccaaaccccaggtcagggattaacctgcatctcaggagtggctcaggctgtggctcctagaaatcctgcttactcttcctcactcacatctcctgggatccccggacctgctctcatttgcaagcagaggtggccgttggtagtgcaaggggtcagactcatggaaaacactgggtgtggagaggtcttgttccccacactctgctggccttgtctccatctcagggagaccagcaggtgggacagcccagtgaggtctgcactagagtccaggtggttctggactgtgtccttgcgagtccagcaggatattccaaccctggagctgtatccctgctgcctgaggcgcctgccccagagactgtttgtccagagactccgactccttcctccaacacaaaatagccctcgtttccatcttccaatatgtgtgctgtttcaaatcctggatgagacacccaatcctgggctttgctctggccttggaaacagcagaaggtggcccaagttcctgtgcccctgctccctcatgggagaacctgaagaacctcctggctccgggattcagattggccatccctgccctggtgcccagctgtgtatagaagcagcagatggaagaccactttctctctctctgcatctgccactctgtatttctgcctttcaaataaataaccaagtctttaaaagaatacaaaagagaaaattcagtccttgctttctctcaacttcataatcaccaggagtaaacaaattttcttctgtcattcaccagaataagagcatcaaccccatgtgtttgcaaaatgtttcctgcaaaattgcaattgttctctcatgtaggattcttacagaacctaagcaattccctcagctgatatagagatgacgatttctgagtggctctgtctaattctgccaacacagcggagtctctgtttcaggtaggaacagagcattggctagtgtgtggctcttcgattgttttattccacctgttgattccataatggagtacctcggaaaggaggtgtatggagcaaaaaggtttattgagctcacagctataagggtgcaagtccaggatcagacagtgagaatgttgtgccatcaggcttcctaatattgtgaacatcatgcagtcatcaggcatcctaatattgtgaacagggatgggagggaccccatccccacacaggatgtcagatgagaccagggctgactctagcagcactgtgctctgtgctgaagctggggacccaggagatctactgtgatctcctccatagcagattccccagaaattaacaaatcccactaggcctcactcgcagagctccccacacttctcctgtggtcatcttgggagctcacctaaaacacacacctcagccacaagcagatcagaaaggtttgcttctacaccaattgtaggcctgatgacacagaacctgtcattcaggatgaagaatctaattgtctatcatagttatttgagactgcagaagacttgggaccagttctaaacacacagacaattttttttatttacatatataacagctgatacagacggttcattttatttttacagctcattttatttatccagcgcttacagagatttcctttttatttctttgggatacaggctattcatcatacatatggtatgtaaatagttacttcccttgtgtgtaggctgctcacttctcatcggtccacttacagtgcagaagctctgtagtctatgcagcatcatctgaaaatgttttcttacattgcatgaactttggggatctaaaagaaaaatcaaggccagactactatcagggagattttgccctgtttccttctagtagctgtacaatggactttgcatctgatgtcagatcctggttgttcaatgctttttatgtaaacatccagacgatgcaccccctgccagtgctgttacgttggggtgaggacaaaccacatccacccccacaggctgctcccagcattccgtgtggttctgttaggggcactggagacctcagcttccttcatgaggccctgaagttgaatctactcatggtgggagtcatcactggatgcactccccagaggcaacaccattccacagctcccaggcacctgtgctggttttaatcagtggtggtcagtgtgagggttgccgggggcaaggagacctgatcagaactcctgactcagtgctctcctgcaggcactgggtcccagcagtgtggcccttccccctgtccttaccctattgcaagcagagcccactcctccaccaggtcctctccctctgctgctggatcatgtccccgactgtcacttccccacgtgccatgcttctcctccccagtcctcagctttgggggtggagccatcccctgaagatgaagacttctgtgtcttgggggatcagtgctggcacagtgtctggggtggactctgctcactaactttttctacaggatttcaccaggacatgggtcatgatggtttcctcctgcaggtgaatcactttcctactcagtggacacagagaagcagggtctggggtattgaggctgaggatgctgttcctgcagagccgtgagcagagccagcactgcttggtgtgtgtgtgtggtctctccaactgagcagctgaaggctgcatgttaggtggaacttaccctccatacttgatgcacggagcctcccatcatgcatgtagggatctcaccacccagtgatcccactgagaggggctctagggaggggacaaggccatgagggttgctgcctgcatgtagggaatacgacctctagagagacccttcagtaactcaagttttaactttcggttattcccatatgaggcaaagaaaaagagagagacactcccatgcactgcactttcccaagtgtcactctggccagctctgcttcccagcctcacccagtttccggacaacaatccggcacatccacgagagtgacagggcccaaatgtcctcccataaacttctgattcctggggctgcaggagcaggaaagtggtattgggagccagtgacacacatgagacacaggctctcctttggtggatgaacgcatcttaaacagtgcaaattttaatgttttatttcctgtatttccatgaaatttgataacacagttaagactgatatactcacaattgtgtcaaatatgatatacctacactattttactttgaattttattcttatcagattttcagacccctatcttacaccttacacaaaatccactcaacatagtataaaggtgtaaatctatgaccctacaatatccaattattagagaacatttgggaaatgctgcaagacattggaataggcaaagagttcttggaaaagaactcaggggcataggcagtcaaaaccaaaactaataaataggattacatccaattgagaagtctctgtacagcaaaaaaaaaaaaaaaaaaaaccctcaggaaagtaaagaggcatcttacataatgggagatattatttgtaagctatgcaattgatatagattaataaccagaatctacaaagtgattaagaaactccacaacaacataacaaataacccagttaagagatgggccaaggacttacacatttttcaaaagaggaagtccaagtggccaacagacacatgaaaaaatgttcaggataactagctgtcagggaaatgcaaatccaaactacaatgtggtttcacctcaccccagccagaacagcttcatacagaaatcaacaaacaacaaatgctgatgaggatgtgtggaaaaaggtgccctaatccactgttggtaggaatgcaaactggtaaagccaccatggaagacagtatagagatacctcaagactctgaatatagacctactataagatccatgaaccccactcctgggaatttacccaggggaaatgaattcattacccaaagtaagttatctgtgcctccgtgtttattgcaaccaattcaaaataactaagaaatgggatcaacctaaatgcccatcaaccgaaaactggataaagaaattatgggatatttatacctggaataatacacagtggtaaaaacaatgaaatccagttatttgcaacacaatggatgaatcaagaaaagctcatacttggtgaaataagccagtcccaaagggacaaataccacatgttcttcctgataggtgagaactaacagagaacctaaaaggaaatctagagaagtgaaatagatactttaagaatggataactagaactgcccttgtcttaactgtcgaggaacaggttttttttttttttttggtttttggttatttttcttcctactatttttttaacttttacttaacatagagtcaatcatacgtgcataaagtcagttgaaaattgatcccagtaaaaaataaggatggaaataagcatgggaggaggaatttggtaactgcaaagctgtatagttctgcatactttcctacagacttacttctgagggtgcagtttaaaaacatgagtgggactccaagtcccaatagcttagtggtaaaaaggtcatcataattgttaaagtgatcatattaagtgttaacatgaagatttagataggataaattgaaagtgatcatataaataggatcaatgcctggtaataatataaatagaattataaaggacagaaagttccaacatgggaagaagtccacacagcagactcattgaatgacaatcgctttaagtaacactctgacctgataatcagcccttaagtcaacctagtcaggctgaaaagccgtgatagcatttcaggcatggaaatctaagacactggggcaaaaatgttctgcctaaaggatctctgtaagtgagaacccaagggaaagaagtggcctcaaagaagaaggtacttttctctaaagcgagaagcaaatttccactttacttatggtcttgtccaaatactgacagtttgtggactcagaaggcttccatagcctaagcagctcatgtcaagagtctcaggtggtcactgacatcatatgtaagagtgtttattgttaaattaacaacaggtctcactgtgcactaactccccatgcaggacctccatcctcaatgagttctattatgagagttaactgtaaaaccagttctcaaacagttcttgtatttgtgtgtgtgtgtgtgtgtgtgtttaaatctttacatagtgtagagttggtcttctgtgtacaaagttaattgaaaatatatcttaatggagaatgggaatggcaaggtgagaggaggaggaggaggggtgagagagtggatgggagggtgggaatgctgggaagaatcactatattcctaaagctgtacgtgtgaaatttgtattccttaaaaaataaatttttaaaaattaaaaattaaaatacaacaatattgttatgttcctaaatattctccaagattttaaaagatttgttgatactacatatggaatacttaagaaaaagttttattatttactgaaagtcagtgttacacagagagtgggaaagacacagagacaagttcttccatctgctggttcatcgcccagatgacagtgacaccaggagacaggagtttctttggggtctcccacgtgggtgcaggggccaaatactaggaccatgcttttctgctctcccaggtgcatcagcaagagacgattggaagtgccgcagctggaacaggaacacacagcactatgggatgcaggcatcataggcagtggattcacctgctgcaccacagtgatgctttctccatttctgcgcattcattctcagtgtacaaatgcagcaccgatgtttcataaatggcacctagtggtggagtatatgattatccatcatttcttgcatgtgctgtgagccctgcagttggcagtttgttactgctagaactttccccctttcacgacatttcatcatggccaccaggacccagtgctcacatcaaggaacacacaacaccaacttcttatcctgcgtgtgagcttccacacatgagaaacacaagaggcacccaaccttcatgccctggctgatgtcactaggcacaatgacctgcatcaaaacaaagatgtcctgaaatcataaatgtacagaatcatggaaagaatcatatgttctgtgtcgttacctgtgctaccaaacaccaggggacactgtgctctgccagaaacctgtcctatctgaagtgcacaaccccatgcctgctatacaggggcagcacatgcaaatagggcctccctctgcccatgaaaaccagcccagcactcaccctgcagctctggcacaggagctccagccccagcactcccaggtgtccactcagtgatcacactcaacacagacgctcaccatggagactgggctgctctggcttctcctggtcgctgtgctcaaaggtaatgatggagaacacggggcactgagtctgggagaggacgtgagtgagagacacagagagtgtgagtgacagtgtcctgaccaggacgtctgtgtttgcagg

SEQ ID NO: 17 - DNA, 2252 bp, Oryctolagus cuniculus
gacacagtgaggggccctcaggctgagcccggacacaaacttccctgcagggccgcacagttccaccagggagtgcacacaatgcattaagctcagaatatggtcctgcacaggtgcagagggaaattaagccctggttacctgtcagggaattggggtttcctctcctacagttctgagggaagactgctacttttatgattctgtccccgccactgacttcactgacatagagaagtttgatgtgacaggatgaagtcctatatgaacaaattcaggttcgtgaacgatgacagtggtgaccagggtcagagatgtgggactctctgaggacctcgtgagtgttttcaagtctgactcaggacactgccctcaaacactgccgactttaggacaattttagttttcccttaaaactcagagagagctgagccagagacttgatttgttaacctcaattatatatgtcatcaaactgctcctgtcagagtagcctgtgtgctaaaatgaaccaaccatcttattttaaaaggtggctgttccacaggttccacagtctttatacccgatctccatttttcctttaatcctgaaacagtctatggtccctgtgtgaacgtcacagcactcagcaatgtacttgcagctcagctgtgtctcaggctgagcttctgtaggcacctgggaagcctacagggacttcctcatcctctaggtcatgggaccctcctgtgggctccctgcctgaactcagaagggaaatgcactggacaatagcagtcaaggtcatcactgaatggaaagtgttgggtgtgcacttccagctgatctggtcctgctccagtgtcgtgggaccccctgcacctgctgtggttcagcagagcataaagtgggacacacagtggctgtgcactctggggctggagtccacatcacggggagctgtgtctgtggctccagcatgatgcccagtgtcctgaggctgaatcacagctgcaggaagagccagtcccagcgaccatgtgtccagagtccctgctcttcactccgtgtctatgctcactggcatcattaatccatttgcagtcttagatcagttttagagagggagacacccaagctgcatatcagagtcctggacagagcccatttacacatttcccacacttgtactgacaatgcaccctggaagacagtaggtgatgattcagttttagagaacagaattttcactatttgccattcttccctttcctgtcatgactgtttgatgaataataagtgaatatagacatatgaggtacaatgatatatgttgaaaaatgaatgtatcaaattgagtggaattatgaagtagagttattgacatgctcatcgcaaaacgcactgtcgctcccccacttgtggaggaacgacaccggaccttgcgctgttgtcttttcccggcccttcctgggtttgctgccgctcccccctgcttccgggaaggagcagcacaccgccggctggctctctcaggggttgctcagatgttcctcctgcatcttgtctctctctcctcctttatagtcctcttccaccaatcccaactctgctggcgttctctccccatgtgctgagcatgctgctctcctccaatcaggagcgggatcagcttctgcagcttgttagtcgaattggtgaggcagctgtgtggtagttgtttattctctctcagcgccatatggtgggagatcagatgcatagaattagtcttagcagttccagtaatttagtctagtctcggttgctccccacacgcacatgtctcatgtagaatggcatctgtctcctgttttggaattctgtagatacaatattcccttaactgctgtcaccatgctgtacagcagatccctcaacgtgtggatcctgccggcctgaagctctgtccttcttactctttactgccatataaacttcctgttaaagtataaccctttccacttgtcccattatccattccatcttcagtggaaatttcactggattatatgtgtgagctctcgtgaattatgctgcattaattgtacatggaactgcagaggtgtttgccacagtggctgtggatcccctgggcacctccctgggatttcatgtttcttctaccaggcaacagtgtttgaggatcctatgataattgtatttctcagcttttgatgttttccatggaagcttgcatgcctgcaggtcgactctagaggatccccggg

SEQ ID NO: 18 - DNA, 4333 bp, Oryctolagus cuniculus
aagcttgatgtgacaggaagaagtcttaaatggacacattcaggttcgtgaacgttgacagtggtcaccaggatcagagatgcaggactactggggacctcgtgagtgttgtccagtctgactcaggacagcgttctcagggcactgccgactttaggaaaattttagttttcccttcaaacccagacagacccgagccagagtcttgatttgctatctcaattttataagccgtccctacctcctgtcagagcagcctgtgtgctgaactgaaccaaccatcttattctaaactgtgggtgttctgcattcactttctacagactttatacccaatctccattttccctttaatcctggaacagtctgtggtccctgtgtgtacgtcacagcactcaggaatgcacttgcagctcagctgtgtctcaggctgggcttctgcaggcatctgggatgcctacagggacttcctcatcctctaggtcctggaaccctcctggggggctccctgcctgatctcaggagggaaatgcactggacattagcagtcaaggtcataactgaatggaaagtgttgggtgtgccttccagctgatctggttctgctccagtgtcgtgggacccctgcacctactgtggttcagggagagcagaaagtgggacacacagtggctgtgcactctggggctggagtccacatcacggggagctgtgtctgtggctccagcatgatgatcagtgtcctgaggctgaatcacagctgaaggaagagccagtcctagagaccatgtgtccagaatctctgctcttcactccatgtctatgctgactggggtcatcaatccatttgcagtctttcatcagttttagagagggagacacccaggctgcatatcagagtgatggacagagcccatttacacatttaccacacttgtactgacaatgcaccctggaagacagtagatgatggatctgttatgaggccccatcaccaaggtgggaacactgatgcagttccatgctcctgggttccagctgccaagccttgagtacactgcctttatttatcatctccataaacattggcaaacacaacaccagtattcagagatctgaatcttcatgattggctattgttcatccttttatcccatgtaggtagcatcacatatcatttgtctccctggcctggatggttagcagagtgtacttttactgacatattatcctaggcacatttttcgccaggaacattaacgttttccaaaattacagaatttcttactctgtactgcatataagcttccttttaaaatgaaactttgttcatttcttcattttccattctttcttccatgagaggtcactggatcatatgtgtgaactcttttgaattatggtgccttaaatgaacaagcaactacagaggtgtttgccacactgactgcagatcacatatacacctccctgggatttcatattcattgtccatgcaatggtgcttgaacatcatgtaataattctatttcagtttttgatgcttttccatatggttttactaattaacctgacacagacttgtaccagggttatcatctctctctacctataaaacatgtcagctctggtatgtctggtaatagccattctaacaggagcgatgggatgtctcattgtgcttctaacatggacatacatgatggtcccaaattgatagcattttatatgtctgtctatatatcttcttttaataatttatagaggtaacataaattttaaaattcatcattttattggcggctcactaggctaatcctccacctgcggcacctgcaccctgggttctagttcaggtcgggcgctggattctgtcccagttgctcctcttccaggccagctctctgctgtgtcccgggagtccagtggaggatggcccaagtgcttgggccctgcatccgcttgggagaccaggagaagcacctggctcctggcttcggatcagctcggtgcgccggctacagcggccatgggagggtgaaccaatggtaaaggaagacattgctctctgtctctctctctgtcactgtccactctgtctgtcaaaaaaaatttatcattttatttaaaaatttgtctgtatgtatttgtcaaaaccacaaagagacagagactgacagtgatcttctaactcctgggtcatttccccaatggctacaaaagattcatatggtcaggcaacagccaggtgcttggaattctgtccagggttcccacgtgggactgcttggaacctcacctacggcctcccagggtgtgcttaggcaggaatctgaaacaggaacaacctaggacacagcactaatcatccggatacgggaggcaggaatccctcaggctcactccagtgctgctcctgtcaccaccttatcatcactgcatttaaggaattgatttcttcccttgggattcagttgcttgagatcattcaacattaggaaaaaggctcctaatcatatgtataattaatcgtcaatatattttaagtatctattttattttaaagtcagtgttatagcaagagatgacgagaccaacacatggagagagaagattccatccactggttcacttcctgaatggctgctaacactgaggatggctcagcctaaaaccaggagcctggaatttcctccagcttcccaaggggctggaaggggacaaacacttgggtcatgatagacagtgatcaccattgcacttcctacctgtgtgagttcaagcttgtggactgcatgtataactaatgtcacatactgtgtgtccacatgtacctggatcatttcttttagtatgtatgctccaggcagacccacatttcctaatgacagaacaatctcattcttaatatatccaaatgggaaaggatcaattcactgttttatgcacacttgcttttttgtagactgaactactgtgaacaaagctgcatagctgaacccaggactgtgggtgacttgtgactcagtgacttctatccagtgcttgagctgaactctgagtcatagttacagaacagggaagagggggaacacagggcagctgataccaggacacaaagcaccactcacaggaaggaataattctgcccacaccacagtgggctgactcagttcaccacaacacacgacaggttccacaaataactagaactgaggtctccaggcctcccaacagagtgatggaaaggaggtggaaatgtgcatgacactgagttgatctgtgcccatttctaccatgcacattccaggagcacataaaccccactaccatgtacagtgttctgtgttcaggaacagttttaaactaaggcaatggaggaataaggaaacaaaacatagttaaccttaaaaatgtacttgcagtctcatctgttttaaagtgggcagcaggcattaggacaaaattgtctaagtccccactagggacacccatgttcccttcacagaactgactgagcccagccttacggcttcccacattttttcctgataatgcataatcagaaactatagatgacactacaagcaaaggagcccctaccaccgacgttggaattacagacacagtttcttgctccagggttcagaaagactaactcctaggggtcataggcatttgggatgtctgggctgtcaacccaaaggcagaaatctcccattgtcaccttttctgtccatctctacatttctgtctctctcaccccttctctctctatcactgtaccaatgtctatcatacagatgataaggaaccaatggttatttacataaatgaatgacatgacactgctaacactagatattaagggtacacacatattagaatgaaacaaggtcattgccttcaactttttaaaattatgataacataaaaattcatatgatctgaatcgtatcatagccatcaccctacacacccaggtaccacgtctgccctgggcactgtcctgtctgaggcgtctgaccccatgcctgcaatataggggcagcacatgcagatagggcctccctctgcccatgaaaacctgcccagccctcaccctgcagctctggcacaggagctccagccccaggactcccaggtgtccactcagtgatcgcactcaacacagatgctcaccatggagactgggctgcgctggcttctcctggtcgctgtgctcaaaggtaatgatggggaaggcggggcactgagtctgggagaggacgtgagtgagagacacagtgagtgtcagtgacagtgtgctgaccaggacgtctgtgtttgcagg

SEQ ID NO: 19 - DNA, 4627 bp, Oryctolagus cuniculus
gacacagtgaagggccctcacactgaacccagacacaaacctccctgaagggcgcgaggctcttctagggggcgcacaagacgcactgagcccagattcctgtcctgcacaggcgcagagggagatgaagccctggtttcctatcagggaattggggtttgctgtcctgtaacagttttgagggaagaattctactttttgattctgtccctcccaacttcaatgacggagagaaagtttgatgtaaaaagaagaagtcctaattgaacaatttggttcatggacagcgactgtgctcaccagggtcagagatgtgggaatattgaggacactattgagtctcttccaacctgactcccgacagcaccctcagggcactgaaagctttggacagtttcagttttccctgtataaccagggacagccgagacagggtcgttgatctgttaaacagcaactattccactcatccctctcctgccacaaccagcaagtgtgcactgaaccaacttttgactctacatgtgtgcgatccacactcactttctgcagactttaacccgacctgcatttccctttaatcctggaacagtctgtggtccctgtgtgaacgtcacagcactcaggaatgtacttgcagctcagctgtgtctcgggctgagcttctgcaggcacctgggaagcctacagggacttcctcatcctctaggtcctgggaccctcctgtgggctccctgcctgaactcaagagagaaatgtgctggacatcagcagtcaaggtcataactgaatggaaagtgttggatgtgcacttccagctgatctggttctgctccagtgccatgggaccccctgcacctgctgtggttcagggagagcagaaagtgggacacacagtggctgtgcactctggagctggagtccacatcacggggagctgtgtctgtggctccagcatgatgaccaatgtcctgaggttgaatcacagctgcaggaagagccagtcttagaccatgtgtccagagtccctgctcttcactccatgtcatgttgactggagttatcactccactttagtctttcatctatttagagagggagacatccatgctgcacatcacattgctggatggagcccatttacacatttcccatacttgtactgacagtgcaccctggaagacagtagatgatggatctgttatgaggccccatcaccaaggtgggaacactgatgcagttccaagctcctgggttccagctgccaagccttgagtacactgcctttgtttatcatctccataaaacattggccaacacaacaccagtattcagagatctgaatcttcatgattgatcatcgttgccatttcatatttataaatgtttcataaataagaattcattatagctctatgaggtacaatgatatgtgtggacaaaatgaatgcatattgagtggaattatgaactcagacttgctgacacgttcatacctcaacacatgtttttggtggagttcagctgtctcctgctcttaggagatttccaaacacagtattctcttaacctctttcaccatgctgtagagtagatccctcagtgtgtggatcctgtgggactggaactctgaccttgctccaccattctctgctcctccctcactcagactttggtcttcaccattgtacttcctgcctctgtgagttcagccttttatcccgcataggtagcatcacatattatgtgtcttcctggcctggatggttagcagtgtgcacttttactgacatattatcctaggcacattattctccaggatcatccaagttgtccaaaattacagaatttcttactctactgcttataaacttccttttaaaatgtaactttttccatttctttcattttccattcttgctttcatgagatgtcactggatcacacgtatgaactcttttgattgatggtgctttaaacgaacaaggaactgcagaggtgtttgccacactgactgcagatcccgtggacacctccctgggatttcatattcattgtaccatgcaatggtgcttgaacatcatgtaataattctatttctagtttttgatgcttttccatacggttttactaattaacctgacacagacttgtaccagggttatcatctctctttacctataaaacatgtcagctctggtatgtctggtaatagccattctaacaggagcgatgggatgtctcattgtgcttctaacatggacatacatgatggtcccagactgataacattttatttgtctgtctatatatcttcttttaataatttatagaaatgatataattttaaaatttatcattttatttaaaaatttgtctgtatgtatttgtccaaaaccacaaagagacggagactgacagtgatcttctaattcctgggtcacttccccaatggctacaaaagctttagctggatgaggcaacagcctggttcttggaattctgtccatgtgtccgcatgggactacttggaacctcacctatggcctcccagggtgtgcttaggcaggaatctggaactggaaccaaactaggacgcagcactaagaatcctgacacgggaggcaggaatccctcaggctcactccagtgctgctcctgtcaccaccttatcagtcactgcatttaaacaattgatttcttcccttgggattcagttgcttgagatcattcaacattaagaaacaggctcctaatcatatgtataattaatcttcaatttattttaagtatctatttattttattttaaagtcagtgttatagcaagagaggaagagaccaacagatggagggagaatcttccttccacaggtttccgtctgaatggctgctaagactgaagatggctcagccagaaaccaggagcctggaacttcctccagtttcctacagggttggaaggggacaaacacttgggtcatggtagacagtgatcaacattgcactgcctacctctgtgagttcaatcttgtggactgcatatataactaatgtcacatactatgtgtctacgtgtaccgggattatttctgttagcatattgtgttccaggcagacccacgtttcctattgacagaatgacctccttcttaatactgaataatattctatgtccaaatgcgaaagaatccattcagtcttctatgcacacttgctttattgtagactgaactattgggaacaaagctgcattacctgaacacaggatggcggctcaattgtgacacagagacttctacccagtgcttgacctcaactcagagtcatgattactagacacagagaagagaggggaacaggggaaggctgataccaggacacaaagcaccactcacaggaaggaataattctgcccacaccgcagtgggctgactcagttcaccacaacacacgacaggttccacaaataatgagaactgaggtctccaggctgcccaactcagagtgattgaaaggaggtggaaatgcgcatgacactgagttgatctgtgcccatttctaccatgcacattccagtagcactctataccccactaccatgtacagtgttctgagttcaggaacagttttaaacagtttaaatagttgttaaactttaaagcaatggaggaagaaggaaacaaaacatagttaaccttaaaaaatccacttgcagtccttcatctgtttaaaagtgggcgacaggcatttggtcaaaattggctaagtccccactagggacacccgtgttcccatcacagaactgactgagcccagcctcacggcttcccacacttttcctcataatgcatcatgggaaactgtagatgacgctacgagcaaaggagcccctaccaccaacgtttgaattacagacacagtttcttgctccagggttcagaaagactaactcctaggggtcataggcatttgggatgtctggggctgtcaacccaaaggcagaaatctcccattgtcaccttttctgtccatctctacatttctgtatctctgaccccttctctctctatcactgtaccaaggtctttcatatagatgaaaaggaactaatggttatttaaataaatgagggacatgatattgctaacattggatatgaggggtacacacatattaaaatgaaacaaggtcattgccttcagtcttttaaaattatgataacataaacattcatatcatctgaatcgtatcatagccatcaccctacacacccaggacaccacgtctgccctgggccctgtcctgtctgaggcgtctgacatcatgcctgctatataggggcagcacatgcagatagggcctccctctgcccatgaaaacctgcccagccctcaccctgcagctctggcacaggagctccagccccagcactcccaggtgtccactcagtgattgcactcaacacagatgctcaccatggagactgggctgcgctggcttctcctggtcgctgtgctcaaaggtaatgatggggaaggcggggcactgagtctgggagaggacgtgagtgagagacacagtgagtgtcagtgacagtgtgctgaccaggacgtctgttttgcagg

SEQ ID NO: 20 - DNA, 6281 bp, Oryctolagus cuniculus
cacaatgaggggccctcaggctgagcccagacacaaacctccctgcagggacgcgcgacctcaccagggggcgcaggagacgcactgagcagacagacccaggaccagatgcagtgggaggtgaatcgctggctcccatccggaaattggggtttgtggtccactaaacctttcttacgttccgatctggatggttgattctgtccctaacaccgatcacgagcagaagttttggtatcacgggaagacgtcacatgaagaaaatggagtcgttttgaaggaatgaataacatctctggggtccccagcatctgagaactgagggagctctgggcacccggggaggcttttccagcccgagtcactgaagagctctccgtggaattctctgatgacgtcatcggggaccccgctgagagcccaggggcagtgtagagtcggtcaggggctatggatgctgcagtgtttcacatccatgccctcccttcctgcacagctgggccctgaggggtgaactgaccccgtggtcctggtcctggggctcccgtgtccattctctacagctgtgccctcgtctccctttcacttcctcaccctgaactcacaggttgaggtccacgtggtccaaatcccaggtcagggattaacctgcagctcaggggtggctcaggctgtggctcctagaactcctgcttgctcttcctcactcacgtctcctgggatccccggacctgctctcatttgcaagcagaggtggacgttggtagtgcaaggggtcagactcatggaaaacactgggtgtggagaggtcttgttccccacactctgctggccttgtctccatctcagggagaccagcaggtgggacagcccagtgaagtaagcactagagtccaggtggttctggactgtgtccctgtgagcccaccaatgatccaaccctggagctgcatccctgctgcatgaagggcctgccccagagactgtgtgtccagagaccccgactccttcctccagggactgcccgcacctgtgctcagccatgctcctcctcctgtggaagcaaaatcatccttgcatctctcagctctgtcggacaaattgtctgctcttcaccaggatagctgcatcaaccccatgtgtttactaaatgtctcctgcaaaaatgcaattgttctctcatgtaggattcctacagaacctgaagcaattctctcagctgatgtagaaatgactaattctgagtggcttcatctaaacctggagacacaggtaagtgttggtttaaggtgggaacagagcagaggctgagtgtggttctttgactgttttattctgcctgttagtaccatcatgcagtaccccagagaggaggtgtatggagcaataaggtttattgagctcacatctgtagaggcttacgtccaggatcagacagtgagaatgttgtgccatcaggcatcctaatattgtgaacatcatacagtgttcaggcatcctaatattgtgaacagggatgggagggaccccatccccacacaggacttcagacgagaccagggctgactctagcagccctgtgctctgtgctgaagctggggacccaggagatctactgtaatctcctccatagcagattccccagaaatgaacaaatcccactaggcctcactcgcagagctcccccacttctcccacggtcaccctggaatcactccaaaacacgcacactttgaggacacactctgccacaggcagaggagggaggtttccttccacacgcattgtaggcctgatgacacagaacctgttgttcaggatgaagccagttgtgtaaaacaggtattctgagacgttagaagactcagggccagttttaaacacagctcgtgcagacagtccttttgttcctttgggatacaggctactgatcatacattctgtatgaaaatagttacttccgtgtgtgtgtaggctgctcacgtctcatcggtccacttgcagtatagaagctctgtagtttatgcagcatcatctgaagaggttttcttacattgcctgaactctggagatccaaaagggaaatcatggacagaccactatcagggagattctgccctatgtttccttccagtagttgtacaatggactttgcatctgatgtcagatcctggttattccatgtttttcatgtaaacatccagaccgtgcaccccctgtcagtgctatcatgttggggccatgttcagcactgatgctgtgaggacaaaccacacccacccccataggctgctcccagcattccgtgtggtcctgttcagggcactggagacctcagcttcctccatgaggccctgacattgaatccactcatgacgtggagtcatcactggatgcactccccagagacgatgtcattccacgtctcccaggcacctgtgctagttttactcagtggtggtcagtgtggggtttgccagggacaaggacacctgatcagacctcctgactcagtgttctgctgcaggcactggggtcccagctctgtggcccttccacctgtccttaccctcctgcacagcagagcccacccctccaccaggtcctctccctcctgctgctggaccctgtccctgactgtcacttccccacatgccatggttctcctccccagtcctgagctttgggggtggagccatcccctgaagatgcagacttctgtgtcttgggggatcagtgctggcacagtgtctggggtggactctgctcacgaacattttctacaggatcccaccaggacatgggtcatgatggtttcctcctgcaggtgaatcactttcctactcagtggacacagaggagcagggtctggggtattgaggctgaggatgctgttcctgcagagccgtgagcagagccagcactgcttggtgtgtgtgtgtgtggtcgctccaactgaacagctgaaggctgcatgttaggtggaacttaccctccatacttgatgcacggagcctcccatcatgcatggggggacctcaccacccagtgatcccattgagaggggctctaaggatgggacaaggccatgagggttgctgcctgcattgaagggactatgaaccttagagagaccctcccatacatttgtggttcctggggctgcaggaacaggaatctgctgttgggcgctagagtcacatgtgagacccttgcactcccttgggggaggtgcatatcttaaacaatgcaactttcattttattatttaccttatatccattgaatttgctaacagttaagattaatgcgctgcacatttgtgccaaatacaatatacttactctaatttatttcagtttttctcttatcagaatttcagatattttggttaaaaactaagaaaccctcattcacctgtgccctacaggacctgcaaactcagtgccttcaacttctgcccctggaaacctacatgatgttcagcgctgaactggatgaaatcagttgtgaaggagcccaaaggggctcaggccttaatgtgacaggaggaggtgggccagggcagggtgacacaggggcagtgggcagcactgtgggatgtgatatttgctcttggtgtagttgtgatgaagagtgagagaggcacagctgagtcgcactcaccacacactttcaacatgtggggctgcctctgtatctatcacaactcaacagcattgggaagcaaattgcccagcagagaaattgtgaagaacagacagacagacaccagcacgtggaacaccacactaagatgcacctgtgtgaaacctggtcccctgtgcatctctctgtcaaaaacagaatccagccaaagtgctccatgttcatgaactaactgttctgaaggaggtcactgtagttggagatgggactgcaaatgtctagacatggcgccctcagatcgcttggacacatccctcagacttcatattccctgtaagcaacagcaggattttttttttttttgacaggcagagtggacagagagagagagacagagagaaaggttttccttttgccgttggttcaccctccattggccgccacgacaggagccaggtgcttctcctggtctcccatggggtgcagggcacaagcacttgagccatcctccactgcactccggggccacagcagagagctggactggaagaggggcaaccgggagagaatctggcgcccctaccgggactagaacctggtgtgccggcaccgcaaggcgaaagattagcctagtgagccctggtgccggccagcaacagcgggatttggcaatttttaaaaaaggtagagacacacagagagaggtcttccatccactggttctctccccagttggccacaatggccgaaattgttccgatccgaaggcaagggccaggagcttcttggggtctcccatgtagattcaggggcccaaagacttgggcaatcttctactgcttcccaggccatagcagagagctggatgggaagaggagcagctaggactacaccggcgctcatttgagatgccagcgcttcaggccactgctttcacccaatgtgccacacaccagctaaagtatgagattggtgaacttttggggtggaagttcacggactggcactttttggtccataactgatatttcattggtgttaatatccagcacacaggtgttttgatgtgtactcaattcttaacacacacacacacactaaaacctaaaaagccatgaattgcttttttaaaaaaagttatttcaatgacattcgacttcaaatttggaagaaacacattcatgtgccagtatcttcaaagattgctcttacataaatcctacccagtcacaatttaacatcatatacatgaaaaactcactatttcaacccttcacagctgtcgctccccgtctttgtggaggaacgacacaggaccctgcactgttctttcgtctgctcggcccttcccgggtttgctgctggttcttcccgggttggctgctggtccttcccgggttggctactgtcccttccacctccgtggaagggcagttccccctgccacattccccacttctgcaggggagcggcacaccgccggccggctctctcgggggctgcacaggtgttccttcagatagatgttccccttagatgttcctggtgcatgctgtctctctcctcctttatagtcctcttccaccaatcccaactctgctacccacacgccaagtacgctgctctcctccaatcaggagcaggtcctacagtttattggttgaactggaggcagctgagcagaagctgtttctcccttctcagtgccatattgtgggagagcagatgcatagaataagtcttaattccagtaacttagtctagtccgagttgctccccacaacagcacattaacaaaatcattaggaaaactggacaaccacaaccaatgacggtacagagcgcacatcgctcctggagctgtcaggtggagtgggaagtcctgtgtgaggaacagaggtgtagagtgtggaggtgcctcctaccagactagagcccctggacacagcacagcctgtctgtgattccttcagtaactgtgcacgtgttcaagggaggtatccctcatgccagtatcacatttctgtgcttgtgcagacacaacacaggggcaggcactgttgtgcagtgagctgagcccttgttgggagcccacacccttgctggagtgatggctcaagaactagcctctccacctcaggccctccttcctgcttgtgaaaaagtaaaggtggggccagtgctgggccatagtatgttacagaccaaatctgcagtactggcatcccacatgtgcaacggttcaagtcccagctgctctacttccaatccagctctcttctacagccagggaaagtggtagaagatggcccaagtccttggttccttgtacccgcatggggatctggaagaagctcctggctcctggcttccaagccgctaagctctatctgttgtgactaattggaagtgatttctctctctctctctctctctctctctctctcgatctctctctctctctctctctgcctctccttctctctgtgtgtgtaactttgactttcaaataaataaataaatgttcaaaatataaattaagggcccgagccagggctcacttggctaaccctcacctgcagcaccggcatcccatattagtgccggattctagtcccagttgctcctcttcc

SEQ ID NO: 21 - DNA, 6368 bp, Oryctolagus cuniculus
cacagtgaggggccctcaggctgagcccagacacaagcctccctgcagggacgcgcggctccaccagggggcgcacaagactcactgagcgcagattctggtcctgcacaggcacagagggagatgaagccctggtttcctatagggatggggtttcctctcctgtaacagttttgagggaagacttcttcttttatgattctgtccctgctactgaattcctgacacagagaagtttgatgtgacaggagaagtcctatatgaaccaattcaggttcagtggtctccaggatcagaaatgtgggtctatctgggtacaacgtgagtgttgtccactctgagtcaggataacgctctcagggcactgccgactttaggacaattttagttttccctttctaccaggacagctgaggcagggttcttggtctttataaatcagctatttaagtatctgtagcctgtcaaaaggagcaagcgtgctgaactgaaccaacctttgacgctacatgtgggtgatccacacaaactttcgatagactttatgctcgatttccatttccctttaacatgaacagtctgtggtccctgtgtgaacatcacagcactcagggatgtacttgcagctcagctgtgtctcaggctgagcttctgcaggcacctgggaagcctacagggacttcctcatcctctaggtcctgggaccctcctgtgggctccctgcctgaactcaggagggaaatgcactggacatcagcagtcaaggtcatcactgaatggaaagtgttgggtgtgcactgccagctgatctggttctgctccagtgtcgtgggaccccctgcacctgctgtggttcagcagagcagaaagtgggacacacagtggctgtgcactctggggctggagtccacatcatggggagctgtgtctgtggctccagcatgatgcccagtgtcctgaggctgaaccacagctgcaggaagagccagtcccagcgaccatgtgtccagagtccctgctcttcactccatgtctatgctgactgggtcatcaatccatttggagtcttagatcagttttagatgggagacacccaggctgcatatcagagtcctggacagagcccatttacacatttaccacacttgtaacggacaatgcaccctggaagacagtagatgatggatctgttatgaggccccatcaccaaggtgggaacactgatgcagttccatgctcctgggttccagctgccaagcctgagtcaactgccttcatttatcatctccataaaacattggccaacacaacaccagtattcagagatctgaatcttcatgattgatcatcgttgccatttcatattcatgaatgttttataaataagaattgagtatagctctatgaggtaccatgatatgtgtggacaaaatgaatgcatattgagtggaattatgaagtcagacttgctgacacgttcatacctcaacacatgtttctggtggagttcagctgtctcctgcttttaggattttccactcacaatattctcttaagctctgtcaccatgctgtgcaggagatgtctcagtgtgtggatcctgtaggactgaaactctgaccttggtccaccatcacctctgttcctccctcgctcagactttggtcttcaccactgtacttcctgcctctgtgccttcagctttttttcccacgtaggtagcatcacatattatgtgtcttcctggcctgaactcaggagggaaatgacttggacattagcagtcaaggtcatcactgaatggaaagtgtacttttactgacatattatcctaggcacattattttccagggtcatccaagttgaccaaaattacagaatttcttactctactgcttgtaaacttcctattaaaatgtaactttgtccatttctttcattttccattcttgcttccatgagatgtcactggatcatatgtgtgaactcttttaaatcaacaaggaactgcagaggtgtttgccatactgattgcagatcccgtggacacctccctgggatttcatattcattgtccatgcaatggtgcgtgaacatcatgcaataattctatttctcagtttttgatgcttttccatacggttttactaattaacctgacacagacttgtaccagggttatcatctctctctacctccataaaacatgtcagctctggtatgtctggtaataggcattctaacaggagcgatgcgatgtctcattgtgcttctaacatgaacatacacgatgttccccgatttgtagcattttacatgtttgcctttatatcttcttttaaaatttataggtgtaccataaaatttaaaatttatcattttattggctggcgccacggctcattaggctaatcctccacctgcggcgcctgcaccctgtgttctagtcctggctggggcactagattctgtcccggttgcccctattccaggccagctctatgctgtggccagggaatgcagtggaggatggccctgtgcccacatgggagaccaggagaagcacctggctcctgccttcggatcagtgtggtgcaccagctgcagcggcaattggagggtgaagcaatggtaaaggaagacctttctctctgtctctctctctcactgtctactctgcctgtcaaaaaaatttatcattttatttaaaaaattgtctgtatgtatttgtccaaaaccacaaagagacggagactgacagtgatctaactcctgggtcacttccccaatggctacaaagcttcagctgggtcaggcgacagccaggtgcttggaattctgtccagggctcccacgtaggactacttggaacttcacctactgcctcccagaggggcttagacaggactctgaaactggaaccaaactaggacgcagcactaagcatcctgacacgggaggcaggaatccctcaggctcactccagtgctgctcctgtctccaccttatcatcactgcatttaaggaattgattgcttcccttgggattcagttgcttgagatctttcaacattaggaaataggctcctaatcatatgtataattaatcttcaagttattttaagtatctatttcattttagccttcacagaatgccagggaggtgattaaccagccaatgatgatggctgccaggcagctccatgatgaagctcgcaaatggtccaacaagggcagtgacatcattgcagcagccaaacgcatggctctgctgatggccgagatgtctcggcttgtgagaggaggcagtggtaccaagcgggcactcattcagtgtgccaaggacatcaccaaggcctcggatgaggtgactcggttggccaaggaggttgccaagcagtgcacagataagcggattagaaccaacctcttacaggtgtgtgaacgaatcccaactataagcacccagctcaaaatcctgtccacagtgaaggctaccatgctgggccggactcccatcagcgacaaggagtctgagcaggccacagacatgctggttcacaaagctcagagcctcatgcagtctgtgaaggagactgtgtgagaagcagaagctgcttcagtcaaaattcgaacagatgctggatttacactgcgctgggttagaaaggctccctggtaccagtaggcacctaactggacatggttggcacagaaacccctactaaatagaaggaaaatgatcaaggcccaggagacacccataggtgctggggcttgaatgccacaacctggcctgacatcagaaaggaatggaggcctcttcatattagaaaccatttatactcttttgtcatggatgctttgagatgtgtctccatataaagcctgcattctcaaaacacagttatattcatgcacactctatcccagtaggcatgggtttctagcccatggacttcacctaagctcagaatccaagtgaacactagccagacacctcttctgcccttattctttaggggacatttccctttctgtttccattttactggtcctcatcctcccatcaggctcccaagacccagagcccaggcaattcagttaagaaggaaatcactgtgcctccaaaaatggttttgggctttccgtgttgctgctgaccctacaaaaaaatgtgaatgacagagttatagcaagagaggaagagaccaacagatggagggagaattccttccactggttcacttcgtgaatggctgcaaaggctgggatggctcagcatgaatccaagagcctggaacttcccccagtttcccgcagggttggaaggggacaaacacttgggtcatggtacacagtgatcaccattgcactgcctacctctgtgagttcaagcttgagggctgcatatataactaatgtcacatactatgtgtccacatctacctggttatttctgttagcatattatgctccaggctgacccacgtttcataatgacagaacaatctcattcttttcttttcttttttttttttttttttttttgacaggcagagtggaaagtgagagagagagacagagagaaaagtcgtcctttgctgttggttcaccctccaatggccgccgcggccggcgcgctgcagccggcacaccacgctgatccaatggcaggagccaggagccaggtgcttttcctggtctcccatggggtgcagggcccaagcacctgggccatcctccactgcactcccaggccacagcagagagcttgcctggaagaggggcaacctggacagaatccggcgccccgacccggactagaacccggtgtgccggcgctgctaggcagaggattagcctagtaagccggggcgctggcctaacaatctcattcttaatactgaataagattctatgtccaaatgtgtaaggatccattcactgttttatgcacacttgatctttgttgactgaactactgtgaacaaaactgtaagctgaacccaggactgcagatgaattgtgacacagtgacttctacccagtgcttgatctcaactcagagtcatgattactagacacagggaagaggggggaacaggggacggctgataccaggacacaaagcaccactcacaggaaggaataattctgcccacaccacagtgggctgactcagttcaccacaacccacgacaggttccacaaataactagaactgaggtctccaggcctcccaacagagtgatgggaaggaggtggaaatgtgcatgacactgagttgatctgtgcccatttctacgatgcacattccaggagcacataaaccccactaccatgtacagacttctgtgttcaggaacagttttaaacagtttaaatagtttttaaactttaaggcaatgaatgaataaagaaaaaaaatagttaaccataaaaaatggacttgcagtccttcatctgtttaaaagtgggcgacaggcattagaggaaataggctaagtccccactagggacacctgagttcccatcagagaactgactgagtccagcctcacggcttcccccacttttccctcataatacatcatgggaaactgtaggtgatgctacaagcaaatgaacccctatgtctgacgttggaattacagtcacattttcttgctccagggttcagaaagactaactcctagatgtcataggcatttgggatgtctggggctgtcaacccaaaggcagaaatttcccattgtcaccttttctgtccatctctacatttctgtatctctcaccccttctctctctatcactgtaccaatgtctatcatacagatgaaaaggaactaatggttatttaaataaatgagggacatgatattactaacactggatatgaagggtacacacaaattaaaatgaaacaaggtcattgccttcaactttgtaaaataatgataacataaaaattcacatgatctaaatcctatcatagccatcaccctacacacccaggtcaccacgtctgccctgggctctctcctgtctgaggcatctgaccccatgcctgctatataggggcagcacatgcaaataggacctccctctgtcaatgaaaccagcccagccctcaccctgcagctctggcacaggagctccagccccaggactcccaggtgtccactcagtgatcacactcaacacagacgctcaccatggagactgggctgcgctggcttctcctggtcgctgtgctcaaaggtaatgatggagaacgtggggcactgagtctgggagaggacgtgagtgagagacacagagagtgtgagtgacagtgtcctgaccatgtcgtctgtgtttacagg

SEQ ID NO: 22 - DNA, 10028 bp, Oryctolagus cuniculus
tacagtgaggggccctcacactgagcccagacacaaacctccctgcaggggagcgcggctccaccagggggcacacaaaacgtactaggccagattctggtcctgcacaggcgcagagggagatgaagccctggtttcctgtcagggaattggggtttgctgtcctgtaacagttttgagggaagaattctactttttgattctgtccctcccaacttcaatgatggagagaaagtttgatgtaaaaggaagaagtcctaaatgaacaatttggttcatggacagcgactgtcgctcaccaggatcagagatgtgggaatattgaggacactattgagtctcttccaacctgactcacgacagcaccctcagggcactgaaagctttggacagtttcagttttccctgtataaccagggacagccgagacagggtcgttgaatctgttaaacagcaactattccactcatccctctcctgccacaaccagcaagtgtacactgaaccaacctttgactttacatgtgggtgatccacactcactttctgcagactttaacccgacctgcatttccctttaatcctggaacagtctgtggtccctatgtgaatgtcacagcactcaggaatgtacttgcagctcagctgtgtctcaggctgagcttctgcaggcacctgggaagcctacagggacttcctcatcctctaggtcctgggaccctactggggggctccctgcctgatctcaggaaggaaatgcactggacatcagtagtcaaggtcatcactgaatggaaagtgttgggtgtgcacttctggctgatctggttctgctccagtgtcgtgggaccccctgcacctgctgtggttcagggagagcagaaagtgggacacacagtggctgtgcactctggggctggagtccacatcacggggagctgtgtctgtggctccagcatgatgaccagtgtcctgaggctggatcacagctgcaggaagagccagtcccagcaaccatgtgtccaaaatccctgctcttcactccatgtctatgctgactgtggtcatcaatccatttgtcgtctttcatctatttagagagggagacacccaggctgcatatcagagttctggacagagcacatttacactatttctatacttggaagtcaaaatgcattctgaagacagcagatgatggatcagttaggagtccccatgaaaaacgtgtgaacgctattgcagttccctgctcctgggttccacctgccaatccttgaatgaactggcatttatttatcatctgcataaaacattggcaaacacaacaccagtattcagagaacttaatctgcagttggccatttttgtcattgccttttcataaatgtttgataaataataactgaacatagacatgagataaatgatatgtgttcaaaaatgactgtatcaaattgatggaattatgaagtcattcttattgacatgctcatcacaaaatccacatgttcccatggtcgaatgtcagtttcctgtgttggaattctgtagacacaatattctcttaacctctgtcaccatgctgtacagtagatccctcagtgtgtggatcctgtgggactgaaactctgaccttgctccaccgtctcctctgttacccccacactcagactttggtcttcacaattgtattatgtctccgtgagttcatccttttatcccatgtaactagcatcacatattatctgtcttcttggactagatgctatactgtacatttactgacacattatccttaggcattattctcagcattatccaagttatccaagacatcagaatttcttcctctttactgccttataaacttcctgttaaaatataactctgtccatttgtccattatccatccttcctcaaggctaatttcactggattatatgtgtgacctcttgagaatgacgctgctttaattgaacatgggactgcagagctgtttgccatagtgactgcacatcccgtggtctcctccctgggatttcatattccttctacccaggcatggtgttggaggatcctgtgataattctatttctcagcttctgatgttttccatgaaagctttcctaatttacctgactccagcctttaccaggttatcttctctctcttcctgcacaacatgtgtcagctctggtatgtctggtgatactcagtctaacaaagggatggggtatctcattgtatctccaacatgtacatgcatgatgatcccatatgaggcattttttatacgtttgcctttatttattttattttaaaaattacaaatatattttacctctttaaaacttgtatttgtgtatttgtccaaaaagaaaaagcaacagagactgacagacagtggtctactgaatcctgggtaacttcccagatgccataaaagaggagttgggtcagaccatagccaggtgcatggaattcagtccaagtctcacacatgggattaactcagattctcgcactgcccctcagagtgcacattggcaggaatctgaaactggacccaaactaggacctaaacataagcatccatacaggagcagcaatcccatgtgataccttcaaggccgctcctgtcaccaccttgtcagtcactgcatttgaataattgatttcttcccttgggattcagttgcttgagttcattcaacattagaagataggctcctattcatatgtacaatatctttcatttcttttaaatatctatttattttatttgaaaggcagtgctatggcaacagaggaagagaccaacagagggagagagaagcttccatccactggtttccttcctgaatggctgcaaaggctgggcaagggcaagactgtagccaggagcctggaacttcctccagtttcccacgaggcttgaaggggacacacacttgagtcatcgttgacagagttccctggtccatgagcagggagctggatttgaaatgcagcaagcagggtctgaacccatgctgctgagtgatgctgcatagggatggcagcttaacctgcggggccacaacattggcccccacgggtgtgatctgaaaatactttctccccatctgcgggcgactcctggttcttcaatcactctctttattctgcagaagctctgtggttggatccatattcttttgcctatttttgcttggttgcctgtactttggagattttcaaaatatcattgcccaaaccaatgtcagcttgcttttgtccagtgttttcttctagaactgcactgtctcggctcttgcttttaaggcattcctcaagttcactctgtttctgtatgtggtatgagatgacatcataattgaattattttaggtgcattcaagtttccccaaccccaggtaacgacaggaaacccatccccatcctgtgcttttttcaccatgcattctcagaactcacattctcagaacatgttcctaaatttctaggttctgttctgtcccagggctctgggtgtctatcttatcccagcaccaggcttgatttcagctcagatgtgatgaagcctcctgctttgccatcacaaaccttgattttcttcatgtgaattctagaattttcttccttttcctggaaaaaatgtcaggctatttcacaggaaatgcattgaatctgtgaatcacattgtagcttggctattttaacaaggtcattcgtcaaatccatgactacatcattccaatttacagggaatcatcaaattccttttcactttttaaattattatgtattgcagaagtatgagtgaagacccctatcttacgccttacacaaaactccactcaacacggattaaagatctaaatctatgaccctacaccatccagttattagagaacatttgtgaaaccctgcaagacactggcacaggtaaagagttcttggaaaagacctgagacataggcagtcaaagccaaaattaataaatgggattagatcaaattgggaagtctctgtgtggcaaaagaaacactcaggcaagtgaagaggcatctgacagcatgtgcgaaattatttgcaagctatgcaatggatatggattaataaccagaatttacaaagagatgaagaaattccaaaaacaaaacaaacaacccagttaagagatgggccaagactcagacatttttcaaaagaggaagtccaaattaccaacagacgtagaaaaaatgttcaggatcactagcggtcagggaaatgcaaatcaaaaccacaaggaggtttcacttcaccccagctagaatggcttcatagagaaatcaacaaacatgaattgctggcgaggatgtgggggaaaaagtaccctaatccactgtaggtgggaatgcaaactggtaaagccactatggaagacactatggagatacttcaagaatctgaatatagtcctaccttatatgacccaggaatcccactcctgggaacttacccaagggaaatgaattcactacacacaagagatacctgtacctccacgttatagaaattgtgggatatgtatgctacctaatactacacagtggtaaaaaaaaatgaaatccagtcatttgcaacagaatagatgattctagaaaagatcatagttagtgaaataagccagtccctaagggacaaataccacatgttcttcctgataggtgagacctaatagagcacccaaaaggaaatctagggaagtgatggcttgagctgcccttgtcttgactgtcgaggaacagttttttgtttatttggttttttgtttattttccttcttactatttgttgaactctacttaacatagagttaatcatatgtatataaagtcaattgaaaagagatctcagtaaaaaaataagaataggaataagagagggaggaaggaagtttgtaactgtaaagctgtatagttctgcatactttcctacagacatacttctgagggtacagttttaacacttgtcacagggctccaagtcccattaagcttagtgggaaaaatgccattgtaattgttaaagtgatcatattgagtgttaaggtgaatatataggtaggattaagttttaaagtgatcatagaaatagggtcaagtgcctggtaataataagagatagaattaaaaaggagagaatgttccaacgtgggaagcaatacacacagcagactcaaagaatgacaatcgctttaagtaacactctgacctcagatgcaccacctaagtcttcctggtctgactgaaaagcccacgagaacatttcagccaagacactgtggcaaaaatattctatatgaaggttctctgtgagtgagacccgtggggaaagaagtggccatcaaagaaggaggtacttttctctcaagggaggagagaacttccactttgcttatggccttgtctaaatactgaaagagattgtagattcaaaggctttcatagcctaagcagctcatgtcaagagcctcgggtggtcactgatgtcatacgtaagagtgttaattgttaaattaacaacaggggcactgtgcactaactccccatgcacgacctctgtcctcaatgagttgtattatgagagttaactgtaaaaccagttctcagtgtgtgtgtgtgtgtgtgtgtgtgtgtattgttgaaatcttcacttagtatagagttggcttctgtttacaaactaattgaaaatgaatcttcatggagcatgggactggcaaggggagagggaagaggaagaggggtgggaatgtaggtgggagggtgggtatggtgggagaaaatgtattccaaaagttgtacttatgaaatttgtattccttaaaaatttttcaaatattaaaaagtaaaaaacaataatattgttatgtggacatcattcacccgaatcctaaattgcctccaaggtttttgaagtgtttttgatgctacaaatgtaattttttagaaaagattcttttatttattgaaagtcagagttacagagagagagaagagacccagagaaagagttcttccacctgctggttcactccccagacgacagtgacaccaggagccaggagtttcttcagggtctcccacttggacacagaggcccaagcactacgaccatgcttttctgctttcccaggtgcatcagcaagagacagattggaagacgaacacacagcagtatgggatgcaggcaacacaggttgaggattcacctgctacaccacagtgacattttctgcattttctgcacttttgttctcaatgtacaatgtaccactgattttcacaaatggcatgaggtagtggagtatatttttatccatcatttcctgcacgtgctgtcagccctgtgttggcagtttgtttctgatagcactttcccccagtcacacatgcactgtgcagactcatccccttgcccagatgcagtgggaggtgaatcgctggttccttcagaaaattggtgtttgtggtcctgtaaccgtttcctacgttccaatctggatggatgattctgtccctaacaccgatcaccgagcagaagttttggtatcacgggaagacgtcacatgaagaaaatggagttgttttgaaggaatgaatgacatctctggggccccagcatctgagacctgagggagctctgggcacccggggaggcttttccagcccacgtcacggaagagctctctgtggaattctctgatgacgtcatctgggaccccgctgagagcccaggggcagtgtggagccggtcaggcgctatggatgctgcagtgtttcacatccatgccctcccctcctgcacagctgggcccccgagggacagagctgaccccgtggtcctggtccctggggctcccatgtccattctctgcagctgtgccctcgtctccctttcacttcttcaccctgaactcacaggttgaggtccacgtgctccaaaccccaggtcagggattaacctgcagctcaggggtggctcaggctgtggctcctagaaaccctgcttgctcttcctcactcatgtctcctgggattcccggacctgctctcatttgcaagcagaggtggccattggtagtgcaaggggtcagactcatggaaaacactgggtgtggagaggtcttgttccccacactctgctggccttgtctccatctcagggagaccgcaggtggaacagcccagtgaagtaagcactagagtccaggtggttctggactgtgtccctgtgagtcctccaatgatccaaccctggagctgcatccctgctgcatgaagggcctgccccagacactgtgtgtccagagaccccgactccttcctccagggactgcccgcacctgttctcagccatgctcctcctcctgtggaagcaaaatcatccttgcatctctcaactctatcatcaccaggaatgaacaaattttctgctcctcaccaggatagctgcatcaaccccatgtgtttactaaatgtctcctgcaaaaatgcaattgttcactcgtgtaggattcttacagaatctgaagcaattctctcagctgatatagaaatgactatttctgagtttctacatctaaattcagagacacgtgtgactctatgtttcaggtgggaacagaggagtggctgagtgttgttctttgactcttttattctgcctgttagtaccatcttgcagtacccaagagaggaggtgtatggagcaaaaaggtttattgagctcacagctgtagagcctggaagtccaggatcagacagtgagaatgttgtgccgtcagcaatcctaatattgtgaacaccatagcagtcttcaggcatcctaatattgtgaacacggatgggagggaccccatccccacacaggacgtcagacgagaccagggctgactccagcaacactgtcctctgtgctgaagctggggacccaggagatctactgtgatctcctccatagcaaattccccagaagtgaacaatctatttctgtaaacatcctgaccgtgcaccccctgccagtgctggtacattggggccatgctcagcactgatgctgtgaggacaaaccacatccacccccagcaggctgctcccagcattctgtgtggtcctgttaggagcactggagacttcagcttcctccataaggccctgacgttgaatccactcatggcgtggagtcatcactggatgcactccccagagacaatgccattccacgtctcccaggcacctgtgctagttttactcagtggtggtcagtgtggaggatgcagggggcaaggagacctgatcagacctcctgactcagtgttctcctgcaggcagtggggtcccagctgtgtggcccttccacctgtccttactctcatgcacagcagagcccacccctccaccaggtcctctccctcctgctgctggaccctgtcccgactgtcacttccccacgtgccatggttctcctccccagtcctcagctttgggggtggagccatcccctgaagatgcagacttctgtgtcttgggggatcagtgctggcacagtgtctggggtggactctgctcactaacattttctacaggatttcaccaggacatgggtcatgatggtttcctcctgcaggtgaatcactttcctactcagtggacacgaggagcagggtctggggtattgaggctgaggatgctgttcctgcagagccgtgagcagagccagcactgcttggtgtgcgtgtgtggtctctccaactgagcagctgaaggctgcatgttaggtggaacttaccctccatacttgatgcacggagcctcccatcatgcatgtggggactcaccacccagtgatccatcctattaagaggaggctctaaggatgggacaaggccatgagggttgctgcctgcattgaagggtataggacattagaaagacccttcagtaactcaagttttaacactcagttattcccacatgaggcagagcagagaaagagacatccttactcactgcactttcccaagtgtcactgtgccagctctgcatcccaacctagcccagtttcaggacaacagtcaggtgcaaccacagaagtgttagggctcaactatcgtcccattaacttctgacctggggctgaagcagcagggatctggtattgggagccttagccacatatgagaccctggcactccttgggggatgagcacatcttaaacagcagaataaaaagtgccatagtaagtgacctcctcccaggtgtgtcatctgccatgggaggaaacggtgtctgtctctcctgccatgggagggccagcatcatgacatcatcatgggaagaaagagctggccctgagcagaccctgactctgggaatgctgtgatctggtggtctcagccctaagaaccacaacacgggccaatgctgtggtgtggtggataaagcatccacatgacatccataatgatgttccagtggtgttgacgtgtacaaggagccgatatcagccatgaaccacacgttgtagtgcagccacatgaaaaacaaagattcaaagcacttatcagggcacaatcacataaggactcccattgtcccattccatatgatgtcaacagacacattcaagacactctcatcagtctgggccctgtagtgtctgaggcatctgacaccagggctgctatataggggcagctcatgcaaatagggcctccctctgtccatgaaaaccagcccagccctcaccctgcagctctggcacaggagctccaggactcccaggtgtccactcagtgatcgcactcaacacagacgctcaccatggagactgggctgcgctggcttctcctggtcgctgtgctcaaaggtaatgatggggaacgcggggcactgagtctgggagaggacatgagtgagagacacagagagtgtgagtgacagtgtcctgaccaggatgtctgtgtttgcag

SEQ ID NO: 23 - DNA, 4621 bp, Oryctolagus cuniculus
aacacagtgaggggccctcaggctgagcccagacacaaacctacctgcaggggagcgcggctccaccagggggcgcataaaatccactgagcccggattctagtcatacacgtgtgcatagggagcccaagccctggtttcctgtcagggatttagggtttcctctcctgtaacagttttgagggaagaattctactttttgatctgtccctcccaacttcaatgacggattgaaagtttgatgtaaaagaagaggtcctaaatgaacaatttggttcatggacagtgactgtgctcaccaggatcagagatgtgggaatattgaagacactattgagtctcttccaacctgactcaggacagcaccctcagggcactgaaagctttggacagtttcacttttcccagtataaccagggacagctgagacagggccgtgatctgttaaacagcaactattccactcatccctctcctgccacaatgagcaagagtgcactgaaccaacctttgactttacatgtgggtgatccacactcactttctgcagactttaacccgacctgcatttccctttaatcctggaacagtctgtggtccctgtgtgaacgtcacagcactcaggactgtacttgcagctcagctgtgtctcaggctgagcttctgcaggcacctgggaagcctacagggacttcctcattctgtaggtgcggagacgctcctggggggctccctgcctgaactcaggagggaaatgccctggacatcagcagtcaaggtcataactgaatggaaagtgttgggtgtgcacttccagctgatctggttctgctccagtgtcataggacaccctgcacctgctgtggttcagggagagcagaaagtgggacacacagtggctgtgcactctggggctggagtccacatcagggggagctgtgtctgtggctccagcatgatgcccagtgtcctgaggctgaatcacagctgcaggaagggccagtcttagaccatgtgtccagagtccctgctcttcactccatgtcatgctgaatagagttattgctctacattagtctttcatctatttagagagggagacatgcatcctgcatatcacagtgctggatgtagcccatttacaaatttcccatacttgtactgacagtgcaccctggaagacagtagatgattgatgtgttatgagggcccgtcaccaaggagggaacactgatgcggttccaagctcctgggttccagctgccaagccttgagtacactgcctttgtttatcatttccataaaacattggcaaacacaacaccagtattcagagatctgaatcttcatgatgggcaattgttgccatttcatattcataaatgtttcataaataagaattcattatagctctatgaggtacaatgatatgtgtggacaaaatgaatgcatattgagtggaattatgaagtcagacttgctgacacattcataccgcaacacatgtttttggtggagttcagctgtctcctgctcttaggagatttccaaacacagtattctcttaacctctgtcaccatgctgtacagtagatccctcagtgtgtggatcctgtgggactggaactctgaccttgctccagcgtctcctctgttcctccctcactcagactttggtcttcactatcgtacttcctgcctctgtgagttcatccttttatcccatgtaggtagcatcacatattatgtgtcttcctggcctggatggttagcagagtgtacttttactgacatattatcctaggcacattattctccaggatcatccaagttgtccaaatttacagaatttcttactctactgcttataaacttcctttgaaaatgtaactttttccatttctttcattttccattcttgctttcatgagatgtcactggatcacatgtgtgaactcttttgaatgacggtgctttaaacgaacaaggaactgcagaggtgtttggcacagtgactgcagatcccgtggacacctccctgggatttcatattcattgtaccatgcaatggtgcttgaacatcatgtagtaattctatttctagtttttgatgcttttccatacggttttactaattaacctgacacagacttgtaccagggttatcatctctctctacctccataaaacatgtcagctctagtatgtctggtaatagccattctaacaggagcgatggaatgtctcattgtgcttctaacatggacatacatgttggtcccagactgatagcattttatatgtctgtctatatatcttcttttaataatttatagaaatgatataattttaaaatttatcattttatttgagaccttgtctttatgtatttgtccataaccacagagagactgagactgacagtgatctaactcctgggtcacttccccaatggctacaaaagctttagctgggtgaggcaacagcctggttcttggaattctgtccaggtgtccacatgggagtacttggaacctcacctacggcctcccagaggggcttaggcaggaatctgaaactggaaccaaactaggatgcagcactaagcatcctggcacaggaggcaggaatccctcaggctcactccagtgctgctcctgtcaccaccttatcagtcactgcatgtacacaattgatttcttcccttgggattcagttgcttgagatcattcaacattaggaaataggctcctaatcatatgtataattaatcttcaatttattttaagtatctatttattttattttaaagtcagtgttatagcaagagagaaagagtccaacagatggagggagaatcttccttccacaggtttccgtctgaatggctgctaagactgaagatggctcagccagaaactgggagcctggaacttcctccagtttcctacagggttggaaggggacaaacacttgggtcatggtagacagtgatcaacattgcactgcctacctctgtgagttcaatcttgtggactgcatatataactaatgtcacatactatgtgtctaagtgtaccgggattatttctgttagcatattgtgttccaggcagacccacatttcctattgacagaatgacctccttctaaatactgaataatattctatgtccaaatgtgaaagaatccattcactcttctacgcacacttgctttattgtaggcggaactattgtaaacacagctgcattacctgaatgcaggactgcgggtgaattgtaacacagagacttctacccagtgcttgacctcaactcagagtcatggttacagaacagggaagaggggggaacaggggaaggctgataccagggcacaaagcactcacaggaaggaataactgctccacaccacagtgggctgactcagttcaccacaacacacaacaggttccactaataactagaactaatgcgtccaggctgcccaactcagagtgattgaaaggaggtggaaatgtgcatgacactgagttcatctgtgcccatttctaccatgcacattccagtagcacattacaccccactaccatgtacagtattctgtgttcaggaacagttttaaacagtttaaatagtttttaaactttaaggcaatggaggaagaaggaaacaaaacatagttaaccttaaaaatgcacttgcagtctttcatctgtttaaaagtgggcgacaggcattaggagaaaattggctaagtccacactaggaacacccgtgttcccatcagagaaatgactgagcccagcctcacggcttcccacacttttcctcataatgcataatcagaaactatagatgacgctacaagcaaaggagcccctaccaccgacgttggaattacagacacagtttctcgatccagggttcagaaagactaactcctaggggtcatgggcatttgggatgtctggggctgtcaacccaaaggcagaaatctcccattgtcaccttttctgtccatctctacatttctgtatctctcaccccttctctctctatcactgtcccaatgtctatcatacagatgaaaaggaactaatgggtatttaaataaatgagggacatgatattgctaacactggatatgaaggatacacacatattaaaatgaaacaaggtcattgccttcaactttttaaaattatgataacataaaaattcatatgatctgaatcctatcatagccatcaccctacacacccaggacaaccacatctcccctgggcactgtcctgtctgaggcgtctgacatcatgcctgctatataggggcagcacatgcagatagggtctccctctgcccatgaaaaccagcccagccctcaccctgcagctctggcacaggagctccagccccaggactcccaggtgtccactcagtgatcgcactcaacacagatgctcaccatggagactgggctgcgctggcttctcctggtcgctgtgctcaaaggtaatgatggagaacgcggggcattgagtctgggagaggacgtgagtgagagacacagagaatgtgagtgacagcttcctgaccatgtcgtctgtgtttgcagg

SEQ ID NO: 24 - DNA, 6528 bp, Oryctolagus cuniculus
cacaatgaggggccctcaggctgagcccagacacaaacctccctgcagggacgcgcgacctcaccagggggcgcaggagacgcactgagcagacagacccaggaccagatgcagtgggaggtgaatcgctggctcccatccggaaattggggtttgtggtccactaaacctttcttacgttccgatctggatggttgattctgtccctaacaccgatcacgagcagaagttttggtatcacgggaagacgtcacatgaagaaaatggagtcgttttgaaggaatgaataacatctctggggtccccagcatctgagaactgagggagctctgggcacccggggactgcaccagggggcacaggagacgcactgagcagactcagacccactcctagatgcagtgggaggtgaatcgctggctcccatctggaaattggggtttgtggtcctctaatccgaatttcctacattccgatctggatggatgattctgtccctaacaccgatcaccgagcagaagttttggtatcacgggaagacgtcacatgaagaaaatggagtcgtttctggaggaattgtggggagcaatccggactggactgagttactggaattaagacttattctatgcatctgctctcccacaatatggcgctgggagagaagtaaacagcttctgcacagctgcctccagttcaaccaataaactgtaggacttgctactgattggaggagagcagcgtactcggcgtgtgggcagctgagttaggattggcggaggaggactataaaggaggagagagacagcatgcaccagggaacatctaaggggaacacctgtgcagcccccagaaagccggccggcggtgtgccgctcccctgcggaagtggggaatgtggccagggggaactgcccttccacggaggtggaagggatagtagccaacccgggaagaaccagcagcaaacccggggagggccgagcagacgaaagaacagcgcagggtcctgtatcgttcctccacgaagagggggagcgacaggaatgaatgacatctctggggccccagcatctgagacctgagggagctctgggcacccggggaggcttttccagcccgagtcactgaagagctctccatggaattctctgatgacgtcatctgggaccctgctgagagcccaggggcagtgtagagtcggtcaggggctatgaatgctgcagtgcttcacatccatgccctcccctcctgcacagctggggcctgaggggtgagctgacctgtggtcctgttccctggggctcccatgtccattctctacagctgtgccctcgtctccctttcacttcctcaccctgaactcacaggttgaggtccacgtgctccaatccccaggtcagggattaacctgcagatcaggggtggctcaggctgtggctcctagaaatcctgttgctcttcctcactcacgtctcttgggatccccgaacctgctctcatttgcaagcagaggtggacattggtagtgcaaggggtcagactcatggaaaacactgggtgtggagaggtcttgttccccacactctgctggccttgtctctatctcagggagaccagcaggtgggacagctcagtgaagtgttcactagagtccaggtggttctggactgtgtgcctgtgagcccaccaatgatccaaccctggagctgcatccctgctgcatgaagggcctgccccagagactgtgtgtccagagaccccgactccttcctccaatgactgcccgcacctgttctcagccatgctcctcctcctgtggaagcaaaatcatccttgcatctctcagctctgtcggacaaattgtctgctcttcaccaggatagctgcatcaaccccatgtgtttactaaatgtctctgcaaaaatgcaattgttctctcgtgtaggattcctacagaacctgaagcaattctctcagctgatgtagaaatgactaattcggagtggcttcatctaaacctggagacacaggtaagtgttggtttaaggtgggaacagagcagaggctgagtgtggttctttgactgttttattctgcctgttagtaccatcatgcagtaccccaagaggaggtgtatgtagcaaaaaggtttattgagctcacatctgtagaggctggaagtccagattcagacagtgagagtgttgtgccatcaggcatcctaatattgtgaacatcatacagtgttcaggcatcctaatattgtgaacagggatgggagggaccccatccccacacaggacgtcagaggagaccagggctgactctagcagcactgtgctctatgcagaacctgaggacccaggagatctactgtgatctcttccaagagcagattccccagaaatgaacaaaccccactaggcctcactcgcagagctcccccacttctcccacggtcaccctggaatcactccaaaacacgcacactttgaggacacactctgccacaggcagaggagggaggtttccttccacacgcattgtaggcctgatgacacagaacctgttgttcaggatgaagccagttgtgtaaaacaggtattctgagacgttagaagactcaggctagttttaaacacagctcatgcagacagtccttttgttcctttgggatacaggctactgatcatacattctgtatgaaaatagttacttccatgtgtgtgtaggctgctcaagtctcatcggtccacttgcagtagagaagctctgtagtttatgcagcatcatctgaaaaggttttcttacgttgcctgaactctggagatccaaaagggaaatcatggacagaccactatcagggagattctgccctatgtttccttctaatagttgtacaatggactttgcatctgatgtcagatcctggttattccatgcttttcatgtaaacatccagaccattaaccccctgtcagtgctatcatgttggggccatgctgagcactgatgctgtgaggacaaaccacatctacccccagcaggctgctcccagcattccgtgtggtcctgttcagggcactggagacctcagcttcctccatgaggccctgacgttgaatccactcatggcgtggagtcctcactgattgcactccccagagatgatgtcattccacgtctcccaggcacctgtgctagttttactcagtagtggtcagtgtagggtttgccggggacaaggacacctgatcagacctcctgactcagtgttctcctgaagacactggggcgcagctctgtggcccttccacctgtccttaccctcctgcacagcagagcccacccctccaccaggtcctctccctcctgctgctggaccctgtccctgactgtcacttccccacgtgccatggttctcctccccagtcctcagctttgggggtggagccatcccctgaagatgcagacttctgtgtcatgggggatcagtgctggcacagtgtctggggtggactctgctcacgaacattttctacaggattccaccaggacatgggtcatgatggtttcctcctgcaggtgaatcactttcctactcagtggacacagaggagcagggtctggggtattgaggctgaggatgctgttcctgcagagccgtgagcagagccagcactgcttggtgtgcgtgtgtggtctctccaactgaacagctgaaggctgcacgttaggtggaacttaccctccatacttgatgcacggagcctcccatcatgcatgtggggacctcaccacccagtgatcccactgagaggggctctagggaagggacaaggccatgaaggttctgcctgcattgaagggaatatgaaccttagagagaccctcccatacatttgtggttcctggggctgcaggaacaggaatctggtgttgggcgctagagtcacatgtgagacccttgcactcccttgggggaggtgcacatcttaaacaatgcaactttcattttattatttactttatatccattgaatttgctaagttaagattaatgcgctgcacatttgtgcaaaatacaatatacttactctaatttatttcagttttactcttatcagattttcagatattttggttaaaaactaagaaaccctcattcacctgtgccctacaggacctgcaaactcagtgccttcaacttctgcccctggcaaacctacatgatgctcagcgctgaactggatgaatctgttgtgaaggagcccaaaggggcttaggccttaatgtgactggaggaggtgggccagggcagggtgacacaggggcagtgggcagcaccatgggatgtcatatttgctcttggcatagttgtgatgaggagtgagtcgcacagctgagttgcactcaccacacacattcaacatgtggggctgcctctgtgtctatcacagctcaacagcattgggaagcaaattgcccagcagagaaagtgtgaagaacagatagacagacactggcacatggaacaccacactcagatgcacctgcgtgaaacctggtcctttgttcatctgtctgtcaaaaacagaatccagccaaagtgctccatgttcatgaactaactgttgtgaaggaggtcaatgtagttggagatgggactgcaaatgtctagacatggcgccctcagatcacttggacacatccctcagacttcatattccctgtaagcaacagcaggattttttttttgacaggcagagtggacagagagagggagacagagagaaaggttttccttttgccgttggttcaccctccattggccgccacggcatgagccaggtgcttctcctggtctcccatggggtgcagggcacaagcacttgagccatcctccactgcactccggggccacagcagagagctggactagaagaggggcaaccgggagagaatctggcgcccctaccgggactagaacctggtgtgccggcgccgcaaggcggaagattagcctagtgagccatggtgccggccagcaacagcaggatttggcaatttttaaaaaaggtagagacacacagagacaggacttccatccactgattctctccccagttggtcacaatggccgaaatttttccgatctgaaggcaagggccaggagcttcttggggtctcccatgtagattcaggggcccaaagacttgggccatcttctactgcttcccaggccatagcagagagctggatgggaagaggagcagctaggactagaccggcgctcatttgagatgccggcacttcaggccagggctttaacccaatgtgccacacaccagctaaatatgagattggtgaacttttggggtgggagttcacggactggcactttttggtccataactgatatttcattggtgttaatatccagcacacaggtgttttgatgtgtactcaattcttaacacacacacacactaaaacctaaaaagccatgaattgctttttttaaaaaagttatttcaatgacattcgacttcaaatttggaagaaacacattcatgtgccagtatcttcaaagattgctcttacataaatccgacccagtcagaatttaacatcatatacacgaaaaactcactatttcaacctttcacagcacattaacaaaatcattaggaaaactggacaaccacaaccaatgacggtacagagcgcacattgctcctggagctgttaggtggagtggaaagtcctgtgtgaggaacagaggtgtagagtgtggaggtgcctcctaccagactagagcccctggacacagcacagcctgtctgtgattccttcagtaactgtgcacgtgttcaagggaggtatccctcatgccagtatcacatttctgtgcttgtgcagacacaacacaggggcaggcactgttgtgcagtgagctgagcccttgttgggagcccacacccttgttggagtgatggctcaagaactagcctctccacctcaggccctccttcctgcttgtgaaaaagtaaaggtggagccagtgctgggccatagtatgttacggaccaaatctgcagtactggcatcccacatgtgcaccggttcaagtcccagctgctttacttccaatccagctctctgctacagcccgggaaagtggtagaagacggcccaagtccttggttccttgtacccgcatggggatctggaagaagctcctggctcctggcttccaagtcgctaaggtctagctgttgcgactaattggaagtgattgctctctctctctctctctctctctctctctctctctctccatctctctctctctctctctgcctctccttctctctgtgtgtgtaactttgactttcaaataattaaataaatgttcaaaatataaattaagggccccagccagggctcacttggctaatcctccacctgcagcaccggcatcccatattagtgccggattctagtcccagttgctcctgttcc

SEQ ID NO: 25 - DNA, 4583 bp, Oryctolagus cuniculus
cacagtgaggggccctcaggctgagcccagacacaagcctccctgcagggacgcgcggctccaccagggggcgcaaaagtctcactgagcgcagattctggttctgcacaggcacagagggagatgaagccctggtttcctgtagggatggggtttcctctcctgcaacagttttgagggaagaattcttcttttatgattctgtccctgctactgaattcctgacatagagaagtttgaattgacaggagaagtcctatatgaaccaattcaggttcagtggtctccaggatcagagatgtgggtctatctgggtacaacgtgagtgttgtccactctgagtcaggacaacgctctcagggcactgccgactttaggacaattttagatttccctttcgaccaggacagctgaggcagggttcttggtctttataaatcagctatttaagtatctgtagcctgacaaaaagagcaagtgtgctgaactgaaccaacctttgactttacttgtgggtgatccacacaaactttcgatagactttatgctcgatttctatttccctttaatcctggaacagtctgtggtccctgtgtgaacgtcacagcactcaggaatgtacttgcagctcagctatgtctcaggctgagcttctgcaggcacctgggaagcctacagggacttcctcatcctctaggtcctgggaccctcctgtgggctccctgcatgaactcaggagggaaatgccctggacatcagcagtcaaggtcatcactgaatggaaagtgttgggtgtgcacttccagctgatctggttctgtctagtgtcgtgggaacccctgcacctgctgtggttcagggagagcagaaagtgggacacacagtggctgtgcactctggggctggagtccacatcacggggagctgtgtctgtggctccagcatgatgaccaatatgctgaggctgaaccacagctgcaggaagagccagtcccagagaccatttgtccagagtccctgctcttcactccatgtctatgctgactggcgtcatcaatccatttggagtcttagatcagttttagatgggagacacccaggctgcatatcagagtcttggacagagcccatttacacatttaccacacttgtaactgacaatgcaccctggaagacagtagatgatggatctgttatgaggccccatctccaaggtgggaacactgatgcagttccaagctcctgggttccagctgccaagcctgagtcaactgccttcatttatcatctccataatactttggcaaacacaacaccagtattcagagatctgaatcttcatgatgggccattgttgccatttcatattcataaatattttataaataagaattgagtatacctctatgaggtacaatgatatgtgtggacaaatgaatgcatattgagtggaattatgaagtcagacttgatgacacattcataccgcaacacatgtttttggtggagttcagctgtctcctgcttttaggattttccactcacaatattcccttaagctctgtcaccatgctgtgcaggagatccctcagtgtgtggatcctgtgggactgaaactctgaccttggtccaccatcacctctgttcctccctcactcagactctggtcttcaccactgtacttcctgcctctgtgccttcagctttttttcccacataggtagtatcacatattatgtgtcttcctggcctggatggtgagcagagtgtacttttactgacatattatcctaggcacattattctccaggatcattaaagttgtccaaaattacagaatttcttactctactgcttataaacttccttttaaaatgtaactttgtccatttctttcattttccattctttcttccatgagatgtcactggatcatatgtgtactcttttaaatgaacaaggaactgcagaggtgtttgccactgtgactgcagatcccgtgaacacctccctgggatttcatattcattgtaccatgcaatggtgcttgaacatcatgtaataattctatttctagtttttgatgcttttccatacggttttactaattaacctgacacagacttgtaccagggttatcatctctctctacctccataaaacatgtcagctctggtatgtctggtaatagccattctaacaggagcgatgggatgtctcgttgtgcttctaacatggacatacatgatggtcccaaattgatagcattttatatgtctgtctatatatcttcttttaataatttatagaaatgatataattttaaaatttatcattttatttcagaccttgtctttatgtatttgtccaaaaccacagagagtgagactgacagtgatcttctaattcctgggtcacttccccaatggctacaaaagcttcagctggatgaggcaacagcctggtgcttggaattctgtccatgtgtccgcatgggagtacttggaacctcacctacggcctcccagggtgtgcttagcaggaatctgaaactggaaccaaactaggacacagcactaagcatcctcacatgggaggcaggaatcccacaggctcactcaagtgctgctcctgtcaccaccttatcatcgctgtatgtacacaattgatttcttcccttgggattcagttgtctgtgttcattcaacattaacaaacaggctcctaatcatatgtataattaatcttcaatgtattttaagtatctatttattttattttaaagacagtgttatagcaacagaggaagagaccaacagatggagggagaattccttccatttgttcacttcctgaatggctgccaaaggctggggatggctaagcctaaagtcaggagcctggaacttcctctagtttcccacagggctggaaggggacaaacatggttgacagtgatcaccattgcacttcctacctctgtgagttcaacttgtggactgcatatataactaatgtcacttactatgtgtccacatgtacttgcattatttcttttagtttgtatgctccagggagacccacatttcctaatgacagaacaacctccttcttaatactgaataatattccatgtccaaatgggaaagaatgcattcactgttttatgcgcacttgctttgtttgagactgaagtattgtgaacaaagctgcaacctgacacaggactgggggtaaattgtgacacagtgacttctacccagtgcttgagctgaactcagagtcatggttactagacacagggaagagggggcaacaggggacggctgataccaggacacaaagcaccactcacaggaaggaataattctgcccacaccacagtgggctgactcagttcaccacaacacacgacagattccacaaataactagaactaatgcgtccaggctgcccaactcagagtgattgaaaggaggtagaaatgtgcatgacactgagttgatctgtgcccatttctaccatgcacattccaatagcactctataccccactaccatgtacagtgttctgtgttcaaaacagttttaaaccatttaaacagtttttaaactttaaggcaatggatgaataaggaaacaaaacatagttaaccttaaaaaatgcacttgcagtccttcatctgtttaaaagtgggtgacaggcattaggagaaaattggctaagtccccactagggacaccggagttcccgtcagagaactgactgagcccagcctcacggcttcccacacttttccctcataatgcatcatgccaaactagatgacactacaagaaaatgagcacctaccactgacgttggaattacagacatagtttcttgcttcagcgttcagaaagactaactcctagatgtcataggcatttgggatgtctggggctgtcaacccaaaggcagaaatctcccattgtcaccttttctgtccatctctacatttctgtatctctgaccccttctctctctatcactgtcccaatgtctttcatatagatgataaggaactagtggttacttaaataaatgagggacatgatattgctaacactggatatgagggtaaacacatattaaaatgaaacaaggtcattgccttcaactttttgaaattatgataacataaaaattcatatgatctgaatcatattatagtcatcaccctacaaacccaggtcacctaattctgccccaggccctatcctgtctgaggcatctgaccccagggctgctatataggggcagcacatgcagatagccctccctctgcccatgaaaaccagcccagccctcaccctgcagctctggcacaggagctccagccccaggactcccaggtgtccactcagtgatcacactcaacacagacgctcaccatggagactgggctgcgctggcttctcctggtcgctgtgctcaaaggtaatgatggggaacgcggggcactgagtctgggagaggacgtgagtgagagacacagagagtgtgagtgacagtgtcgtgaccaggacgtctgtgtttgcagg

SEQ ID NO: 26 - DNA, 7165 bp, Oryctolagus cuniculus
cacagtgaggggccctcacactgagccaagacacaaacctccctgcaggggagcgcggctccaccagggggcacacaaaacgtactaggccagattctggtcctgcacaggcgcagagggagatgaagccctggtttaagtcagggaactggcatttcctctcctgtaacagttttgagggaagaattctactttttgattctgtccctcccaacttcaatgacggggagaaagtctgatgtaaaaagaagaagtcctaaatgaacaatttggttcatggacagcgactgttgcttaccagggtcagagatgtgggaatattgaggacactattgagtctcttccaacctgactcaggacagcaccctcagagcactgaaagctttggacagtttcagttttccctgtataacgagggacagctgagacagggccgttgatctgttaaacagcaactattccactcatccctctcctgccacaaccagcaagtgtgcactgaaccaacctttgactttacatgtgggtgatccacactcactttctgcagactttaacccgacctgcatttccccttaatcctggaacagtctgtggtccctgtgtgaacgtcacagcactcagaaatgcacttgcagctcaggtgtgtatcaggcagagcttctgcaggcacctgggaagcctacagggacttcctcatgctctaggtcctgggaccctcttgggggactcactgccagaactccgaggggaaatgccctggacatcagcagtcaaggtcataactgaatggaaagtgttgggtgtgcacttccagctgatctggttctactccagtgttgtgggaccccctgcacctgttgtggttgagggagagaagaaagtgggacacacagtggctgtgcactctggggctggagtccacatcatggggagctgtgtctgtggctccagcatgatgcccagtgtcctgaggctggatcacagctgcaggaagagccagtcttagaccatgtgtccagagtccctgctcttcactccatgtcatgctgactggagttatcgctccactttagtctttcatctatttagagagggagacatccatgctgcatatcacagtgctggatggagcccatttacacatttccaatacttgtactgaaaatgcaccctggaggacattagatgatggatatgttaggaggccccatcaccaaggtgggaacactgatgcagttccatgctcctgggttccagctgccaagccttgaatgcactgccttcatttatcatctccatagaacattggcaaacacaacaccagtattcagagatctgaatcttcatgatttcccgttttgcccatttaattatcataaatgtttaataaataatatttaatataaaatatgaagtacaacgatatgtgttgaataaatgaatgtatactgaatggaataatgaagtcagacttattgacatgtttatcacaaaacccacgtttttcctggtagaatatcttttttctaatgtcttggaattctgcagacactgtattcccttcactgctgtcaccatgctgcacagtagatccctcaacgtgtggatcctgtaggactgaaactctgaccttgctccatcgtctcctctgttcctcccaagcacagacgttggtcttcaccatcgaatttctggcttgttagttcatcctttttattccatgtacgtagcatcacatattatttgtcttcttggcctggatattttagcagagtgtacttaccctgacatattatccttggatattattctccaggatcatccatgttatccaagataccagaatttcttcctctttactgccttataaacttcctgttaaaatataactctgtccatttgtcctattatccattccttcttcaatgctaatttcactggattatatgtgtgaactcttgagaatgacgctgctttaattgaacatgggactgcagagctgtttgccacagtgactgcacatcccgtggtctcctccctgggatttcatattccttctacccaggcatggtgttggaggatcctgtgataattctatttctcagcttctgatgtttttcatgaaagctttcctaatttacctgactccagcctttaccaggttatcttctctctcttcctgtacaacatgtgtcagctctggtatgtctgataatacaaagtctaacaaagggatgggatatctcattgtttctccaacatgcacatgcatgatgatcccagatttaaagcattcttgtacgtttgcctttacatattttctttaaaaaattacagatatacttttacctcttttaaaacttgcatttgtccaaaaagaaaaagagacagagactgacaacagtgatctactgaatcctggagcacttcccagatgcccataaaagctggcatttggtaagaccatagccaggtgcatggaattcagttcaggtctcacacatgggattaactcagacttctcctactgcctcccagagtgcacattggaggaatctgaaattgcgacctaaactgggacataaacctaagcatcctgatgcggaaggaaggaatcccacaggctaacttcaatgctgctcctgtcacccacattgtcagtcactgcatttgaacaattgattgcttcccctgtgattcagttccatgagttcattcaacatttgaatctaggctcctaaccatatatatagttatctttcatttattttaaaaatctatctatttgatttgaaaggcagtgctatggcaagagaggaagagaccaacagagggagagagaagcttccatccactggtttccttcctgaatggctgcaaaggctgggcaagggcaagactgtagccaggagcctggaacttcctccagtttcccacgaggcttgaaggggacacacacttgagtcatcgttgacagagttccctggtccatgagcagggagctggatttgaagtgcagcaagcagggtctgaacccatgctgctgagtgatgctgcatagggatggcagcttcacctgtggggccaaatgttggacaacccatgtgtgactgaaagtgctttctacccatctgtggttgtctttggttcttcaattactccctttgctacacagaagctctgtggttgaatccattatcttttgcctatttttgcttggttgcctgtacattggagattatcaaaataccattgcccaaaccaacgtcagcttgcttttgtccagtgttttcttctagaactgtactgtctcaggtcttgcctgtaaggcattcctcaagttcactctgttctaatctggtgtgagatgaccacataactgaattattttcaggtgcattcaagtgtccccaaccccaggtaatgacaggaaacccatccccatcctgtgctttttcaccgtgcattctcagaactcacattctcagaacgtgttccttatttctaggttctgttctgtcccagggctctgggtgtctatgttatcccagcaccaggcctgatttcagctcagatgtgatgaagcctcctgcttttctagctttcctcaagaccattcagccatcatgaaccctgttttttcatgataattcttgaagttgcttcctggtcctgtgaagaatgtcaggctgtttcacaggaaatgcattgaatctgcaaatcacattgtagcttggctattttaacaaggtcattccctcaaatccatgactacgtcattccaatttacaggtaatcttcagattccttttcactttttaaattattatatattatggaagtaagaagcaagagccctatgttacaccttacatgaaaatccacacaagatggattaaagatttaatctatgaccatacaccatccggttattagagaacatttaggaaaccctgcaagacactggcacaggagtagaatttttggaaaaacctgagacatagtcagtcaaagacaaaattaataaatgggattatatcaacttgagaagtctctgtatggcaaaagaaacacccaggtaattgagaggtatctgagagaatgtgcaaaatatttgaagctatgccactgatagggattaataaccagaatctacaaagggattaagaaatcccaaacaacaaaaacaactgagttaagagatgggccaataactcaggcatttttcaaaagaggaagtccaaatggccaacagacacatgaaaaaatgttctggatcactagccatcagggcaaagccatccatcatgcagtaccccatagggaggtgtatggagcacaaaggtttcttgagctcacagctgtagaggctggaagtccaggatcagacagtgagaatgttgtgccatcaggcatcctaatattgtgaacacggatgggaggaccccatccccacacaggacgtcagacgagaccagggctgactccagcaacactgtgctctgtgttgaagctggggacccaggagatctactgtgatctcctccatagcagattccccagaagtgaacaatctatttctgtaaacatccagaccgtgcatcccctgccagtgctatcatgttggggccatgctcagcactgatgctgtgaggacaaaccacacccacccccacaggctgctcccagcattccgtgtggccctgataggtgcactggagacctcagcttcctccatgaggccctgacattgaatccactcatggtgtggagtcgtcactggatgcactccccagagacgatgtcattccacgtctcccaggcacctgtgctagttttactcagtggtggtcagtgtggaggatgcaagggggcaaggagacctgatcagacctcctgactcagtgctctcctgcaggtactggggccccagctgtgtggcccttccccctgtcattaccttcctgcacagcagagcccacacctccaccaggtcctctccctcctgctgctggaccctgtccccgactgtcacttccccacgtgccatgcttctcctccccagtcctcagctttgggggtggagccatcccctgaagatgcagacttctgtgtcttgggggatcagggctggcacagtgtctggggtggactctgctcacgaacattttctacaggatcccaccaggacattggtcatgatggtttcctcctgcaggtgaatcactttcctactcagtggacacagaggagcagggtctgggctattgaggctgaggatgctgttcctgcagagccgtgagcagagccagcgctgcttggtgtgcgtgtgtggtcgctccaactgagcagctgaaggctgtatgttaggtggaacttaccctccatacttgatgcacggagcctcccatcatgcatgtggggacctcaccacccagtgatcccactgagaggggctctagggaggggacaaggccatgagggttgctgcctgcattgaagggaatacaacccttagaaagatgcttcaggccagtgccgcggctcactaggactatcctccgcctgctgcgccggcactccgggttctagtcccagttatggcaccggattctgtccaggttgctcctcttccagtccagctctctgctgtggcccgggaaggcagtggacgatggcccaagtgcttggggcctgcaccctcatgggagaccaggaagaagcacttggcttccggcttcgaattggcacagcgcgctggccatggcccaccagtagaggtggccatttgggggataaaccaatggaaggaagacctttctctctgtctctctctctctaactctgcctgtccaaaaaaaagacccttcaataacttaagttttaattttgagttatcacacatgaatcagaaaggagaacaagagaaagagagatgttccgacactgtactttcccaaatgttgctgtggccaggtctgcttcccagcctagcctggtctcaggtcaacaatcaggtgcatcccctagagtgacagggcccaaaattcctcccataaacttctgggtcctggggctgcaggagcaggaatctggtactgagacccacagtgaatctgttgtgaaggagcccaaagtgtttcaggccttaaagtgacgggaggaggtgggccggggctgggtgacacaggggcagtgggcagcaccgtgggatgtgatatttgctcttggcataggtgtgatgaggagtgagagaggcacagctgagtcgcagtcaccacaagcacacattcaacatgtggggctgcctctgtatctatcacagctcaacagcattgcccatggaagcaaaattgcccagaaaagaaatgtgaagagcagacaggcagacactggcaagtggaacaccacactcagatgcacctgcatggaacctggtcccctgtgcatctctctgtcaaaaatggaatccagcaaaagtgctccttgttctgctgctggcagggagttctgcagacctcaccaggaagcccccatgagtgctgagggtggactggggcagagctgagtcctgtggtgaggggcacggatcaaggtgctggggactcctcttaccacactggagctggggacacatccacactgtactgatgatttctcctgtaatgttgaatggaccaagacctacagtaacccatgaaaacatgttgtaggtccactcacataaaaggaccaagacagggttcagtgtgcaatgagagcacacaattcatcactcgtcccataagtgtgcactgacagactgccccgggacactctcatcagtctgggcacagtcttgtctgaggcgtctgaccccatgcctgctatataggggcagcacacgaaaatagggcctccctctgcccatgaaaaccagcccagccctcaccctgcagctctggcacaggagctccagccccaggactcccaggtgtccactcagtgatcacactcaacacagacgctcaccatggagactgggctgcgctggcttctcctggtcgctgtgctcaaaggtaatgatggggaacgcggggcactgagtctgggagaggacgtgagtgagagacacagagagtgtgagtgacagtgtcgtgaccaggacgtctgtgtttgcagg

SEQ ID NO: 27 - DNA, 6474 bp, Oryctolagus cuniculus
gacacagcaaggggcctcaggctgagcccagacacaaacctccctgcagggacgcacggctccaccagggggcgcacaagactcactgagcgcagattctggtcctgcacaggcgcagagggagatgaagccctggttgcctgtagggatggggtttcctctcctgtaacagttttgagggaagaattcttcttttatgattctgtccctgctactgaattcctgacacagagaagtttgatgtgacaggagaagtcctatatgaaccaattcaggttcagtggtctccaggatcagagatgtgggtctatctgggtacaacgtgagtgttgtccactctgagtcaggacaacgctctcagggcactgccgactttaggacaattttagatttccctttcgtccaggacagctgaggcagggttcttggtctttataaatcagctatttaagtatctgtagcctgtcaaaaggagcaagtgtgctgaactgaaccaacctttgacgctacatgtgggtgatccacacaaactttcgatagactttatgctcgatttctatttccgtttaacatgaacagtctgtggtccctgtgtgaacgtcacagcactcaggaatgtacttgcagctcagctgtgtctcaggctgggcttctgcaggcacctgggaagcctacagggacttcctcatcctctaggtcctgggaccctcctggggggctccctgcctgaactcaggagggaagtgcactggacatcagcagtcaaggtcatcattgaatggaaagtgttgggtgtgcacttccagctgatctggttctgctccaatattggggaccccctgcacctgctgtggatcagggagagcagaaagtgggacacacagtggctgtgcactctggggctgtagtccacatcacagggagctttgtctgtggatccaatatgatgaccagtgtcctgaggctcaaccacagctgcaggaagagccagtcttagaccatgtgtccagagtccctgctcttcacccagtagctatgctgatgtcatcaataacccattgtagtttttcatcaattttagagtagtagagacacccaggcttcatatcaaattgctgcactgaatctacaaaatttcccacacttgtaatgaataataaacctggaagacagtagatgatggatctgttatgaggccccatctccaaggtgggaacactgatgcagttccatgctcctgggttccagctgccaagccttgagtgcactgccttcatttatcctctccataaaacattcggcaaacacaacaccagtattcagaaatctaaatcttcatatttggacatttttctcttttgattttcataaatgtttgataaataatatttgattatggacataagaggtacaatgatatctgttgaaaaaatgaatgtgtattaatggaattatgaagtctctcttattgacatgctcatcacaatcccacttgtttccaggtatagtatcatttttctcctgcttggaattctgtggacacaatattctcttaactgctgtcaccatgctatacagatcattcaaagtgtggatctgtcagactgaaactctgaccttgctccagcgtctcctctgttccgccctcactcagactttggtcttcaccattgtattctgcctctgtgagttcatccttttgatcccacgtaactagcatcacgtattatttgtcttcttgtaaggatggtgagcagagtatacttatcctgacctattatccttggacattattctccaggatgatccaagttgtccaaaataaagaattccctccactttactgccatataaacttcgtgttaaaatacaacttttccatttcctcaattattgatttccttattcaatgaaaatttcattggattattgtgtgaactcttgtgaatgaccctgcattaactcaacatggaactgctgaggtgtttgccacagtgactgcagatcagtggacccctcactgggatttcatattccttctaataggcaatgctgtttgaagatcttgtgataattctatttcccagtttttcatgcttttccataatgttttttcctatttacctggctccagccttggaccaaggttgacatctctctctctcctccttcatgaggcttgtaggtctgatatctctgataatactaattctaacaggaggaatggcatgtctcactgtgcttctaacatggaaatgcatgatgtttgcctttacatatgcactttgaaaatttgaagatactatttcatttattttaaaatttgtatttacatattttccataaacaaaaagagactgagactgacagtgatcttctaactcctgggtcacctccccgatggctacaaaagcttcagctgggagaggcaagagcctggtgcttggaattctgttcagggctccacgtaggactacttggaacatcacccacggcttccccgaggggcttaggcaggaatctgacactggaaccaaactaggacacagcactaagcatgctgatacaggagcaggaatccctcaggctcactccagtgctgcaccggtcaccaccttatcatcactgcatgtacacaattgatttcttcccttgggattcagttgcttgagatcattcaacatttggaaacaggctcctagtcatatgtataattaatctttcaatttttaaagaaacctatttttttattttaaagtcagtgttatagcaagagaggaagagaccaacagatggagagagaatcttccatccactggttcacttcctatatggcagcaaaggtcaggttgggcaagcctaacgccaagagcctggaacttcctccagtttcccacatcccttgaaggggacacacacttgagtcatcgttgacagagttcccaggtctggatcccagcagggagctggatttgaagtagagcaagcagaatctgaacccatgctcctgagtgatgcatgccacaagtcggccccctcggctatgatctgaaaatactttctccccatcggtgatcatatccttgttcttcaatctttctctttgttactcagaatctgcagttggatccattattctttgtctatgtatcttggttgcctgtactttggagattatcaaactatcattgcccaaaccaatcagaacttgctttactcctgtgttttcctctagaactttacagtattgggtcttgcctttaagagtttcatcctgttcactctttttggtatactggtgtgagatgacagcatgatgaattattttaggtgcactcaagtttccccgacaccatgaaattccgcattcagtttcccgaaacatttcagatgacctcattgcatgaacccatgggaagcacaggtggacatttgtattcaaggaataatctgcttggaaagtgtgtggtgtggacttacaggttctgtttctgctccagtgtggtggaatccactgcactgcagtgtttcagggtgagaagagggggacagtccagggccctaactccggggccagagtccccatccctgggatctgggtgccaggggctgccacacactgacccacctggtgagctgaatcagtgctgcgtgatgagccagcccccagaccatttgatcagaatccccgctcctccctccctggctccccctggctgtcctcatcagtacttcatccttaccaagagaaaataactcctattctgtaaagttcatactggtcaagggcaaaccaagttcctgcagccagaaatgcccagtgcagagatcccctgtgttttacaggatattttctgctaaattgcaattgatctgccatgaacagtcttacagaaactgcagccagtcactcacctcatgcagcaatgtgtgttctgagtgactcccatctaaatccagagacacaaaaattcctactaaattaaaacagttgtcacatctctgccttttctgagagaagattgacaaacagaaagtgtttctatttagctggagactgtattcatgcatttgcctagagaattcattgacaaaatccaccatctgacacagtgaattccattgttatgtgagaacacctcatatctacagtactagaaaatgtgaaatttaatttgtcagatatctacagtcacaagaaattaccccaccaagagaattcactcaaattgtaactgatagaaacatattccatttgtgtaaacaccacgacagaatctcccaccaggtgctgatgggctgtcagttgtatgagacgctgtgtccccagggtgacaaatggcaagactgcaccatggtgagaagagagtggccctgtctgggcaagcaggactggggtctctgatggctgtgttttcaagcagttggcaggtgggccttggtggtccatgaactaacgtcttgtgaaaccagttggacacagggagcttggggggtaaagtaaacagcacagagagaggtttccatggacttgatctgagtgaagacaggggcttatctatgaatgactcaggttcacacatgggaggggaggaattcgagagggcagtggtggggcagttgtgccagccggactcgacagataacctcttacgtgccgatgaactcacagcccttgtgactgcattagtaccaggaatgattgcaacaccacgtaattttcttcttagaataaaaccacaggcagatgcaagacaagtcaacagagaattgtcccttcaaaatagatttcattgttaaactgaaaaatagtacctgaatctatatgtgaggtataaggaaaggtgttgatgtagatttatttcatcaggaattctagagtcagacgaactcacaagtccttccctagcaacactaccattctttgtgatcgaatgacaaatgcctactcctgcaggaactggaaagaacacaataaagcttcataactgttgtccccgtgctgtgcagtagatctctccacgtgcctctctggtcacagaaaactctctgtgctcgcaggaatgtggtcccttttcttctctactcccagactcagtatctgcattgtacttcctgcctctgtgagctcatgattgcggattccacatataattaagatcatcagggccagtgctgtggtgtagtgggtaaagccttcagtgctggcatcccatatggatgccagttggagtcctggctgttccactttcaatccagctccctgctgtggcctgggtaggcagtagaagatggctgacatcttcagctcccgtaatccatgggagacccagtgcaggcaactggctcctagattcagatcagtgcagctccaaccattgttaccaattggagagggagcccgtggatggaggacttctctctctctctcagtgcctctccttctttctctatgtatctctgactaaaaaaatgaaataaatctttataaaaatgaggaaaatcacatggtacaaaaccacgtttttaagaaaaagctaaacaaaaataattaaccttaaatgaatccactggcagtctaaaagtgggcagcaggaattaggacacaattggctaagtccccactaaggacacccacgttcccatcagagtgctgcttcagcacagccacacggcttcccaccatttgatgataaagcatcatgggaaactgtacttgacgctacaagcgaaagagtccctaccacctccgtaggaaacacagacccagttttttgctctagggtttagaaaggctaactcctagatgttgtaggcatttggtattgtggagctgtcaagcgaaaggcaaaaatctcccattgtcaactcactgtccatctctacatttctgtttccctcatcaattctctctctgtcactgttccaatgtcatgagaatagttaaaaatgaacaaaaggttactttaaaatgaaggacatgatattgctaacactggatattaagggcacacacatattagaatgaaatgaagtcattgccttcaactgttaaaataacaatgagaaaataaaaattcatacaatctgaattctatcatagccatcaccctacacccccaggacaccacatctgccctgggcacagtcctgtctgaggcatgtgaccctatgcctgctatataggggcagcacatgcaaatagggcctccctctgcccatgaaaaccagcccagccctcaccctgcagctctggcacaggagctccagccccaggactcccaggtgtccactcagtgatcgcactcaacacagacgctcaccatggagactgggctgcgctggcttctcctggtcgctgtgctcaaaggtaatgatggagaacgcggggcactgagtctgggagaggacgtgagtgagagacacagagagtgtgagtgacagtgtcctgaccaggacgtctgtgtttgcagg

SEQ ID NO: 28 - DNA, 7228 bp, Oryctolagus cuniculus
gacacatgaggggccctcaggctgagcccagacacaaacctccctgcagggatgcgcggctccagcagggggcgctcaagacgcactgattgcagattctgatcttgcacaggcgcagaaggagatgaagccctggtctcctgtgagggaattggggtttcctctcctgtaacagttttgagggaagaattctacttttttattctgtccctcaaacttcaatgacggggagaaagtttgatgtaaaaggaagaagtcctaaatgaacaatttggttcatggacagcgactgtgctcaccaaagtcagagatgtgggaatattgaggactctattgagtctcttccaacctgactcaggacagcaccctcagggcactgaaagctttggacagtttcagttttccctgtataaccagggacagccgagacagggccgttgatctgttaaacagcaactattccactcatccctctcctgccacaaccagcaagtgtgcactgaaccaacttttgactctacatgtgtgtgatccacactcactttctgcagactttaacccgacctgcatttccctttaatcctggaacagtctgtggtccctgtgtgaacgtcacaacactcaggaatgtactgctgctcagctgtgtctcaggctgagcttctgcaggcacctgggaagcctacagggacttcctcatcctctaggtcctgggaccctcctgtgggctccctgcatgaactcaggagggaaatgcactggacatcagcagtcaaggtcatcactgaatggaaagtgttgggtgtgcacttccggctgatctggttctgctccagtgtcatgggaccccctgcacctgctgtggttcagggagagcagaaagtgggacacacagtggctgtgcactctggggctggagtccacatcacggggagctgtgtctgtggctccagcatgatgcccagtgtcctgaggctgaatcacagctgcaggaagagccagtcccagagaccatgtatccagagtccctgctcttctctccatgtctatgctgactggcgtcatcaatgtattttcagtctttcatcagttttagagagggagacacccaggctgcatatcagagtcctggacagagcccatttacacatttctcatacttgtactgacagtgcaccctggaagacagtagatgatggatctgttatgaggccccatcaccaaggtgggaacactgatgcagttccatgctccagggttccagctgccaagccttgagtgcactgccttcatttatcatttccataaatctccatatatacttccttttaaatataactctgtccatttgtcccattatccattccttcttcaatgctaatttcactggattatgtgtgtgaactcttgagaatgacgctgctttaattgaacaggggactgcagagatgtttgtcacagtgactgcacatcccgtggtctcctccctggatttcatattccttctacccaggcatggtgttggaggatcctgtgataattctatttctcagcttctgatgttttccatgaaagctttcctaatttacctgactccagcctttaccaggttatcatctctctcttcctgcacaacatgtgtcagctctggtatgtctggtgatactcagtctaagaaagggatggggtatctcattgtttctccaacatgtacgtgcatgatgatcccagatttaaagcatttttatacatttgcctttatatattttattttaaaaattacagatacactttcacctcttttaaaacttgtatttgtgtatttgtccaaaaggaaaaagagacagagactgacagacagtgatctactgaatcctggtaacttcccagatgcccataaaagctgagttgggtcagatcatacaggtgcatagaactcagtccaggtctcacacatgggataaactcagacttctcatactgcctcccagagtgcacattggcaggaatctgaaattgggatctaaactgggacataaacctgagcatcctgatgcaggaggcaggaatcccacgtgataccctcaatgctgctcctatcacccaccttgtcagtcactgcatttaaaccattgattgcttcccctgtgattcagttgcttgagttcattcaacatttggatctaggctcctaatcatatgtacaattatctttcatttattttgaatatctatgtatttgatttgaaaggcagtattatagcaagagaggaagagaccaacagagggagagagaagcttccatccactggtttccttcctgaatggctgcaaaggctgggcaagggcaagactgtagccaggagcctggaacttcctccagtttcccacagagctcgaaggggacacacacttgagtcatcgttgacagagttccctcatccatgagcagggagctggatttgaagtgcagcaagcaggatctgaacccatgctgctgagtgatgctgcatagggatggcagcttaacctgtggggccacaatgttggacaacctatgtgtgatctgaaaatgctttctccccatctgtggttttttggttcttctattactctctttgttacacagaagctctgtagttggatccattatcttttgcctatttttgcttggttgcctgtactttggagattatcaaaatatcattgcccaaaccaatgtcagctcacttttgtccagtgttttcttctagaactttacagtctcggctcttgcctgtaaggcattcctcaagttcactctgtttctacatctggtgtgagatgatcacataattgaattatttcaggtgcactcaagtgtccccaaccccaggtaatgacaggaaacccatccccatcctgtgctttttcaccgtgcattctcagaactcgcattctaagaacgtgttcctttatttctaggttctgttctgtcccagggccctgggtgtctatgttatcccagcaccaggcctgatttcagctcagatgggatgaagcctcctgctttgctatttttcctcaagaccattcagccatcatgaaccctggttttttcatgagaattcttgaagtttcttcctgacctgtgaagaatgccaggctgttagcaggaaatgcattgaatctggaaatcacattgtagcttggctattttaacaaggtcatttcctcaaatccatgagtacgtcattccaatttacaggtaatcatcaaattccttttctctttttaaattattatgtatttcagaagtgggatgcaagactcctatcttacaccttacacgaaaatccacgcaaggtggattaaagatctaaatctatgaccctacaccatccagttattagagaacatttaggaaaccctgcaagacactggcacaggaaaagaattcttgaaaaagatctgagacataggcagtcaaagaccaaattaataaatgggattatatcaaattgagaagtctctgtatggcaaaaaacactcaggcaagtgaagaggcatctgacagtatgtgcaaaatatttgaagctaagcaactgatacggattaataaccaaattctacaaagagattaagaaattccaaacaacaaaaacaactgagttaagagatgagccaagaactcagacatttttcaaaagaggaagtccaaatggccaacagacacatgaaaaaatgttccggatcactagccatcagggcaaagccatccatcatgcagtaccccatagggaggtgtacggagcaaaaaggtttcttgagctacagctgtagaggctggaagtccaggatcagacagtgagaatgttgtgccatcaggcatcctaatattgtgaacacggatgggagggaccccatccccacacaggacttcagacgaaaccagggctgactctagtagcactgtgctctgtgctgaagctggggacccaggagatctactgtgatctcctccatagcagattccccagaagtgaacaatctatttctgtaaacatccagaccgtgcaccccctgccagtgctgttaccttgtggccatgctcagcactgatggtgtgaggacaaaccacatgcacccccacaggctgctcccagcattccatgtggtcctgttcagggcctggagacctcagcttcctccatgaggccctgacgttgaatccactcatggtgggagtcgtcactggatgcactccccagagacgatgccattccacgtctcccaggcaccagtgctagttttactcagtggtggtcagtgtggaggatgcagggggcaaggacacctgatcagacctcctgtctcagtgctctcctgcaggcactgggtcccagcagtgtggcccttccacctgtccttacctcctgcacagcagagcccacccctccaccagggtcctctccctcctgctgctggaccctgtccccgactgtcacttccccacgtgccatgcttctcctccccagtcctgagctttgggggtggagtcatcccctgaagatgcagacttctgtgtcttgggggatcagtgctggcacagtgtctggggtggactctgctcacgaacattttctacaggatcccaccaggacatgggtcatgatggtttcctcctgcaggtgaatcactttcctactcagtggacacagaggagcaggctctggggtattgaggctgaggatgctgttcctgcagagccgtgagcagagccagcgctgcttggtgtgcgtgtgtgtgtggtctctccaattgagcagctgaaggctgcatgttaggtggaacttaccctccacacttgatgcacggagcctcccatcatgcatgtagggacttcacccccaagtgataccattgagaggaggcgctacagaggggacaaggccatgagggttgctgcctgcattgaagggaatacgacccttagagagactcttcaggctggcaccgcgggttactaggctaatcctccgcctgcggcgccggcactccaggttctagtcccagttatggcgccggattctgtcccggttgctcctcttccagtccagctctctgttgtgacctgggagtgcagtggaggatggcccaggtccttgggccctgcaccctcatgggaggccaggaagaagcacctggctcccggcttcgaataggcacagcgcgccggccatggcccgccagtggaggcggccatttgggtgataagccaacggaaggaagacctttctctctgtctttctctctctctctctctatctctgcctgtccaaaaaaaaaaaaaaagaaagaaaagaaaagaaagaaagaaagaaagacccttcagtaacttaagttttaaatttgagttataacacatgactcagagagaattagagaaagagagatgttccgacactgtgctttcccaaatgtcactatggccaggtctgcttcccagcttagcccggtctcaggaaaacaatcaggtgaatccacaagcatgacagggcccaaatatcctcccataaatgtctgggtcctagggctgcaggagcaggaatctggtattgggagccagagccacacatgggaccctggcactctcttgggggatgtgcgcatcttaaacagtgcaactttcaatttattatatcctttatttccatgaaatttgatgaaacagttatgactaatgcactacttatttgtgcaaaatatcctattcttactctgctttactttcagtttcattcttgtaagattttcagatattttggttaaaaactaagaaaaacccattcacctgggccccacagaacctgcaaactcaggaccttcgacttctgccacaaaacctgcttgttgctcatggggctcaggccttaatgtgactggaggaggtgggcaagggcagggtgacacaggagcagtgggcagcaccgtgggatgtgatatttgctcttggcgtagttgtgatgaggagtgagagaggcacagctgaattgcactcaccacacacgttcaacatgtggggctgcctctgtatctatcacagctcaacagcattgcccacggaagcaaaattgcccagcaaagaaattgtgaagagcagacaggcagacagacactggtacctgcgtggaacctggtcctctgtgcatctctctgtaaaaatggaatccagcaaaagtgctccttgttctgctgctggcagggagttctgcagacctcaccaggaagcccccatgagtgctgagggtggactggggcagagctgagtcctgtggtgagggttatggatcaaggtgctggggattcctcttaccacactggagctggggacacatccacactgtactggtgatttctcctgtaatgttgaatggaccaagacctaagggaacccatgaatacacgttgtgggtccattcacataaaaggaccaagagagggttcagtgtgcaatgagagcacacaatttaccactcgtcccataagtgtgcactgacagactgcctcaggacactctcatcaatctggaccctgtcctgtctgaggcgtctgaccccatgcctgctatataggggcagcacatgcagatagggctccctctgcccatgaaaacctgcccagtcctcaccctgcagctctggcacaggagctccagcaccaggactcccaggtgtccactcagtgttcgcactcaacacagacgctcaccatggagactgggctgcgctggcttctcctggtcactgtgctcaaaggtaatgatgggccggcgccccggctcactaggttaatcctccgccttgcggcaccggcacaccgggttctagtcccggtcttggcgccggattctgtccctgttgcacctcttccaggccagctctctgctgtgacctgggagtgcagtggaggatggcccaagtgcttgggccctgcaccccatgggagaccaggagaaatacctggctcctgccatcggctcagcacggtgaaccaacggcaaaaggaagacctttctctctgtctctctctctctctctctctctctctctgtccactctgcctgtcaaaaaaaaaaaaagaagaagaagaagaagtgaacgtagggcactgagtctgggagaggacgtgagtgagagacacagagagtgtgagtgacagtgtcctgaccaggatgtctgtgtttgca

SEQ ID NO: 29 - DNA, 4755 bp, Oryctolagus cuniculus
ggcagagtgaggggccctcagtcagagcccagaagcgaacctccctgcaggggagtgcggctccaccagagggcgcgcaagacgcactgagcacagattctggtcctgctcaggcgcagagggagatgaagccctggtttcctgtcagggatttgggtttcctctcctacagttttgagggaagaattctccttttatgactctgtcccttcctttgacttcactgacgtagagaagtttgaagtgacaggaagaagtcctaaacggacacattcaggtttgtgaacgatgacagtggtcaccaggatcagagatgcaggactatctggggacctcgtgagtgttgtccagtctgactcaggacagcgttccaggacactgccgactataagacaattttggttttccttcaaacccagacagacccgagccagagtcttgatttgctacctcagttttataagtcgtcccatcctcctgtcagagcagcctgtgtgctgaactgaaccaaccgtcttattttaaactgtgggtgttctgcattcactttctacagactttatacccaatctccatttccctttaatcctggaacagtctgtggtccctgtgtgcacttccagctgatctggttctgctccagtgtcatgggaccccctgcacctgctgtggttcagggagagcagaaagtgggacacacagtggctgtgcactctggggctggagtccacatcacggggagctgtgtctgtggctccagcatgatgcccagtgtcctgaggctgaatcacagctgcaggaagagccagtccaagagaccatgtgaccagagtccctactcttctctccatgtctatgctgactggcgtcatcaatgtattttcagtctttcatcagttttagagagggagacacccaggctgcatatcagagtcctggacagagcccatttacacaataccacacttgtaactgacaatgcaccctggaagacagtagatgatggatctgttatgaggccccatcaccaaggtgggaacattgatgcagttccatgcttctgggttccagctgccaagccttgagtacactgccttcatttatcatctccataaacattggcaaacacaacaccagtattcagagatcaatcgtcatgattggccatcattgctatttcatattcctaaatgtttgataaataatattgagtatagctctatgaagtacaatgatatgtgtggtcaaaatgaatgcatactgagaggaattgtgaagtcagacttgatgacacattcataccacaacacatgtttttggtggagttcacctgtctcctgctcttaagagatttctactcacaatattctcttaacctctgtcaccatgctgtgcagtagatccctcagtgtgtggagcctgtgggactgaaactctgaccttgctccagcgtctcctctgttcctccctcgctcagactttggtcttcaccattgtactttctgcctctgtgagttcagccttttatcccatgtaggtagcatcacatattatgtgtcttcctggcctggatgcttagcagagtgtacttttactgacatattatcctaggcacattattctccgggaccatccaagttgtccaaaatcacagaatttcttactctttactgcttataaacttccttttaaaatataactttgtccatttctttcataatccattcttgcttccatgagatgtcactggatcatatgtgtgaactcttttgaatgacggtgctttaaatgaacaaggaactgcagaggtgtttgccacagtgactgtagatcccgtggacacctccctgggatttcatattcattgtaccatgcaatggtgcttgaagatcatgtaataattctgtttctagtttttgatgcttttccataatggttttactaattaacctgacacagacttgtaccagggttatcatctctctctacctccataaaacatgtcagctctggtatgtctgataataggcattctaacaggagggatgggatgtctcattgtgcttctaacatggacatacatgatggtcctagatttgtagcattttatatgtttgtctttatatcttcttttgaaatttatagatgtaacataaattttaaaatttatcattttattggccagcgcatggctcactaggctaatcctccacctgcggcaactgcactccgggttctagtctcggtcgggcgctggattctgtcctggttgcccctcttccagtccagctctctactgtggcccaggagcgcagtggaggatgatccaagtgcttgggccctgcacccgcttggagaccaggagaagcacctggctcctggctacggatcagcgcggtgcagcggctacagcggccattggagggtgaaccaacggtaaaggaagacattgctctctgtctctctcactgccactgtccactctgcccatcaaaaaaatttatcattttatttaaaaatttgtctgtatgtatttgtccaaaaccacagagagactgagactgacagtgatctcctaactcctgggttacttctcgatggatacaaaattcagctaggtcaagcgacatccagttgcttggaattctgtccagggctccacgtgggactacttggaacttcacctacggcctcccagaggggcttaggcaggcatctgaaaccggaaccatactaggacacagcactaagcatcctgacacgggaggcaggaatccctcaggctcactccagtgctgctcctgtctccaccttatcatcactgcatttaaggaattgattcagttgcttgagatctttcaacattgggaaataggctcctaatcatatgtataatcaatcttcaatttactttaagtatctatttattttattttaagacagtgttatagcaagagaggaagagaccaacagatggagggagaattccatccactggttaacttcctgaatggctgcaaaggctagggatggctgagcctaaagtcatgagcttggaacttccaccagtttcccacagggaggaaggggacaaacccctggttcatggtagacagtgatcaccattgctcttcttatctctgtgagttcaacttgtggagttcaacttgtgcatgtataactaatgtcacatactatgtgtccacatctacctggattatttctgttagcatattatgctccaggctgacccacgtttcctaatgacagaacaacctccttcttaatactgaataatattctatgtccaaatgtgaaataatccattcactgtttaatgcacacttgatttattgtagactgaactattatgaacaaaactgcattacctgaacccaggactgcgggtgaattgtgacacagtgacttctacccagtgcttgagctgaactcagagccatgattacagaatagagaagacagtggaacacagggtggctgataccagggcacaaaacaccaccaaaggcaggaataattctgcccacaccacagtgggctgactcagttcaccacaacccacgacaggttccacaaataactagaactgaggcctccagacctccaaacacagagtgatggaaaggaggtggaaatgtgcctgacactgagttcatctgtgcccatttctgcatgcacattccaatagcacacaaaccccactaccatgtacagtgttctgtgttcaggaacagttttaaacagtttaaacagtttttaaattttaaggcaatgatgaataaggaaacaaaacatagttatcctaaagatatccacttgcagtccttcatctgtttaaaagtgggcgacagccattaggacaaaattggctaagtcaccactagggtcacccgtgttcccatcagagaactgactaagcccagcctcacggcttcccacacttttccctcataatgcatcatgggaaactgcaggtgacactaagagcaaatgaggccctaccactgacattggaattacagtcacattttcttgctccagggttcagaaagactaactcctaggggtcataggcatttgggatgtctggggctgtcaacccaaaggcagaaatctccctttgtcaccttttctgtccatctctacatttctgtatctctcaccccttctctctctatcactgtcccaatgtctttcatatagatgataaggaactaatggttatttaaataaatgaaggacatggtattgctaatactcgatatgaagggcacacacatattaaaatgaaacaaagtattttcctttaactttttaaaataatgataacataaaaattcatatgatctgaatcttatcacagccatcaccgtacacccccaggtcaccacatctgccctgggccctgtcctgtctgaggcgtctgaccccatgcctgctatataggggcagcacatgcaaatagggcctccctctgcccatgaaaaccagcccagccctcaccctgcagctctggcacaggagctccagccccaggactcccaggtgtccactcagtgatcgcactcaacacagacactcaccatggagactgggctgcgctggcttctcctggtcgctgtgctcaaaggtaatgatggagaacgcggggcactgagtctgggagaggatgtgagtgagagacacagagagtgtgagtgacagtgtcctgaccatgtcgtctgtgtttgcagg

SEQ ID NO: 30 - DNA, 2453 bp, Oryctolagus cuniculus
gacacagtgaggggccctcaggctgagcccagacacaaacctccctgcagggatgcgcggctccagcagggggcgctcaagacgcactgattgcagattctgatcttgcacaggcgcagaaggagatgaagccctggtttcctgtcagggatttggggtttcctctcctgtaacagttttgagggaagaattctacttttttattctgtccctcaaacttcaatgacggggagaaagtttgatgtaaaaggaagaagtcctaaatgaacaatttggttcatggacagcgactgtgctcaccaaagtcagagatgtgggaatattgaggactctattgagtctcttccaacctgactcaggacagcaccctcagggcactgaaagctttggacagtttcagttttccctgtataaccagggacagccgagacagggccgttgatctgttaaacagcaactattccactcatccctctcctgccacaaccagcaagtgtgcactgaaccaacttttgactctacatgtgtgtgatccacactcactttctgcagactttaacccgacctgcatttccctttaatcctggaacagtctgtggtccctgtgtgaacgtcacaacactcaggaatgtactgctgctcagctgtgtctcaggctgagcttctgcaggcacctgggaagcctacagggacttcctcatcctctaggtcctgggaccctcctgtgggctccctgcctgaactcaggagggaaatgcactggacatcagcagtcaaggtcatcactgaatggaaagtgttgggtgtgcacttccggctgatctggttctgctccagtgtcatgggaccccctgcacctgctgtggttcagggagagcagaaagtgggacacacagtggctgtgcactctggggctggagtccacatcacggggagctgtgtctgtggctccagcatgatgcccagtgtcctgaggctgaatcacagctgcaggaagagccagtcccagagaccatgtatccagagtccctgctcttctctccatgtctatgctgactggcgtcatcaatgtattttcagtctttcatcagttttagagagggagacacccaggctgcatatcagagtcctggacagagcccatttacacatttctcatacttgtactgacagtgcaccctggaagacagtagatgatggatctgttatgaggccccatcaccaaggtgggaacactgatgcagttccatgctcctgggttccagctgccaagccttgagtacactgcctttatttatcatctccataaaacattggcaaacacaacaccagtattcagagatcttaatcttcatgttttgcctcagttcaccacaacccatgacatgttccaccaataactagaactgaggtttccaggcctcccaacagagtgatggaaaggaggtggaaatgtgaatgacactgagttgatctgtgaccatttctacaacacacagattccaatagcacactacaccccactaccatgtacagtgttccgtgttcaggaacagttttaaactaaagcagtgaatgaataagggaacaaatcatagttaaccttaaacaaatccacttatagtctttcatctgtttaaaagtgggtggcaggcattaggacaaaattggctaagtccccgctagggacacccatgttcccatcagattgttgcttgagcccatcctcacagtttccaatactttttcctgataatacatcttgggaaactgtagatgacgctacaagtgaatgagaccctaccaccgatgtgggacacacagttttctgctccaggttttagaaagtctaactcctagatgtctcaacattcatgtttctctcactccttctctctctgtcgctgtttcaatgtcattagaatagttaataatgaaccaatggttattttaaaaatgaaggacatgatactgctaacattggatataaagagtacaaacattaaagtgaaatgaggtattgccttcaaatgtttaaaaataataacataaaatttgccttgatctgaatcctatcatagccatcaccccacaccaccaggacacccacatctgccctaggcacagtcctgtctgaggcatctgaccccatgcctgctatataggggcagcacatgcaaatagggcctccctctacccatgaaaaccagcccagccctcaccctgcagctctggcacaggagctccagccccaggactcccaggtgtccactcagtgattgcactcaacacagacgctcaccatggagactgggctgtgctagcttctcctggtcgctgtgctcaaaggtaatgatggggaacgcggggcactgagtctgggagaggatgtaagtgagagacacagagagtgtcagtgacagtgtcctgaccaggacgtctgtgtttgcagg

SEQ ID NO: 31 - DNA, 4160 bp, Oryctolagus cuniculus
gacacatgaggggacctcaggctgagcccagacacaaacctacatgcagggacgcacggctccaccagggggcgcacagacgcactgagcagactcagacccattccctgatgaggtgggtgaatcgctggttctgtcaggaaattggggtttgtggtcctctaatccgaatttcctacattccgatctggatggatgattctgtccctaacgccgatcactgagcagaagttttggtatcacgggaagacgtcacatgaagaaaatggagtcgtttctggaggaatgaatgacatctctggggtccccagtatctgagacctgagggagctctgggcacccggggaggcttttccggtccgagtctcaaaggagctctccgtggaattctctgatgacgtcatctgggaccctgctgagagctcaggggcagtgtagagctggtcaggggctatgaatgctgcagtgtttcacatccatgccctcccctcctgcacagctgggccctgaggggtgagctgaccccgtggtcctgttccctggggctcccgtgtccattctctacagctgtgccctcgtctccctttcacttcttcaccctgaactcacaggttgaggtccacgtgctccaaaccccaggtcagggattaacctgcagctcaggggtggctcaggctgtggctcctagaactcctgcttgctcttcctcactcacgtctcctgggatccccggacctgcactcatttgcaagcagaggtggccgttggtagtgcaaggggtcagactcatggaaaacactgggtgtggagaggtcttgttccccacactctgctggccttgtctccatctcagggagaccagcaggtgggacagcccagtgaagtctgcaccagagtccaggtggttctggactgtgtccctgtgagtccaccaatgatccaaccctggagctgcatccctgctgcatgaagggcctgccccagagactgtgtgtccagagaccctgactccttcctccagggactgcccgcacctgttctcagccatgctcctcctcctgtggaagcaaaatcatccttgcatctctcaactttatcatcatcaggaatgaacaaattgtctgcacttcaccaggataactgcatcaaccccatgtgtttactaaatgtttcctgcaaaatgcaattcttgtctcgtgtaggacttttacagaacctgaagcaattctctcagctgatgtagaaatgactatttctgagtgactccatctaaatccagagacacagctgagtctatgttgcaggtgggaacagagcagtggttgagtgtggttctttgagtgttttattctgcctgttagtaccatcatgcagtaccccatagggaggtgtatggagcacaaaggtttattgagctcacagctgtagaggctggaagtccaggatcagacagtgagaatgttgtgtcatcaggcatgataatattgtgaacagggatgggagggaccccatccccacacaggacatcagacgagaccagtgctgactccagcaacactgtgctctgtgctgaagctggggacccaggagatctactgtgatctcctccatagcagattccccagaagtgaacaatctatttctgtaaacatccagaccatgcaccccctgccagtgctatcacgttggggccatgctcagcactgatgctgtgaggacaaaccacatgcacccccacaggctgctcccagcattctgtgtggtcctgttcagggcactggagacctcagcttccttcatgaggccctgacgttgaatccactcatggtgggagtcgtcactggatgcactccccagagacaatgccattccacgtctcccaggcacctgtgcttatttactcagtggtggtcagtgtgggggtcctgggggcaaggacacctgatcagacctcctgactcagtgttctcctgcagacactgggtcccagcagtgtggcccttccacctgtccttacctcctgcacagcagagcccacccctccaccaggtcctctccctcctgctgctggaccctgtcctgactgtcacttccccacgtgccatggttctcctccccagtcctcagctttgggggtggagccatcccctgaagatgcagacttctgtgtcttgggggatcagggctggcacagtgtctggggtggactctgctcacgaacattttctacaggatcccaccaggacatgggtcatgatggtttcctcctgcaggtgaatcactttcctactcagtggacacagaggagcagggtctggggtattgaggctgaggatgctgttcctgcagagccgtgagcagagccagcactgcttggtgtgcgtgtgtggtcgctcccaactgagcagctgaaggctgcatgttaggtggaacttaccctccatacttgatgcacggagcctcccatcatgcatgtggggacctcaccacccagtgatcccattgagaggggctctagagaggggacaaggccatgagggttgctgcctgcattgaagggactatgacacttagagagacccttctgtaactcaaggtttaactttcagttattcacccatgagtcagagaggagaaacagagagagacactcccactcactgcactttaccaaataacactgtggccaggtctgcttcccagcttagcccggtctcaggacaacaatcaggtgcatccacaagcatgacagggcccaaaattcctcccataaacttctgggtcctggggctgccggagcaggaaactggtactgggagccagagccacacatgggaccctggcactctcttgggggatgtgcgcatcttaaacagtgcaactttcaatttattatatcctttatttccatgaaatttgatgacacagttaagactaatgcactacttatttgtgcaaaatatcctattcttactctgctttactttcagtttcatttcattcttggaagattttcagatattttgattaaaaactaagaaaaacccattcacctgggccccacagaacctgcaactcaggaccttcgacttctgccacaaaacctgcatgttgctcaaggctgaactggatgaatctgttgtgagggagtccaaaggggctcaggccttaatgtgactggaggaggtgggcccagggctgggagacacaggggcagtggacagcactgtgggaagtgatatttgctcttggcataggtgtgatgaggagtgagagaggcacagctgagtcgcactcaccacacactttcaacatgtggggctgcctctgtatctatcacagctcaacagcattgcccatggaagcaaaattgcccagcaaagaaattgtgaagagcagacagacagacagacactggcacttgcgtggaacctggtcccctgtgcatctctctgtaaaaatggaatccagcaaaagtgctccttgttctgctgctggcagggagttctgcagacctcaccaggaagccccagtgagtgctgagggtggactggggcagagctgagtcctgtggtgaggggcacggatcaaggtgctggggactcctcttaccacactggagctggggacacatccacactgtactgatgatttctcctgtaacgttgaaatggaccaagacctaagggaacccatgaatacacgttgtgggtccattcacataaaaggaccaagagagggttcagtgtgcaatgagagcacacaatttaccactcgtcccataagtgtgcactgacagactgcactgggacactctcatcagtctgggccctgtcctgtctgaggcgtctgaccccatgcctgctatgtaggggcagcacatgcagatagggcctccctctgcccatgaaaacctgcccagccctcaccctgcagctctggcacaggagctccagccccaggactcccaggtgtccactcagtgatcgcactcaacacagacgctcaccatggagactgggctgcgctggcttctcctggtcgctgtgctcaaaggtaatgatggagaatgcggggcactgagtctgggagaggacgtgagtgagagacacagagagtgtgagtgacagcttcctgaccaggacgtctgtgtttgcagg

SEQ ID NO: 32 - DNA, 4246 bp, Oryctolagus cuniculus
ggcagagtgaggggccctcagtcagagcccagaagcgaacctccctgcaggggagtgcggctccaccagggtgcgcacaagacgcactgagcccagattctggccctgctctgatgcagagggaaatgagccctggtttcctgtcagtgatttgtggtttgttctacagttttgcggcaagaattctacttcatgattctgtctgttccactgacttcactgacttagagaagtttgatgtgacaggaagaagtcctgaatggacacattcaggttagtgaactatgacagtggtcaccagggtcagagatgtgagacaatcaggggacctcgtgagtgttgtccagtctgactcaggacagcgttccaggacactgccgactataagacaattttagttttccttcaaacccagagagagccgagtcagagcattgatttttcaccttaattatataagtcatgacacatcctgtcggagtagcctgtgtgctgcactgaaccaactgtcttattttaaactgtgggtgttctgcattcactttctacagactttataccccatctccatttccctttcatcctggaacagtctgtggtccctgtgtgaacgtcacagcactcaggaatgtactgcagctcagttgtgtctcaggctgagcttctgcaggcacctgggaagcctacagggacttcctcatcctctaggtcctgtttctctcctgtggggctccctgcctgaactcaggagggaaatgcaccggacatcagcggtcaaggtcatcactgaatggaaagtgttgggtgtgcacttccagctgatctggttctgctccagtgtcgtgggaacccctgcacctgctgtggttcagggagagcagaaagtgggacacacagtggctgtgcactctggagctggagtccacatcacggggagctgtgtctgtggctccagcatgatgcccagtgtcctgaggctgaatcacagctgcaggaagagccagtcccagagaccatgtgtccagagtccctgctctttactccacgtctatgctccaaaggtcaatccatttggagtctttcattaacattccagtgggagtcactcaggctgcatacagagtgctggacagagcccacttacaggctttcccatacttgtactgaaatgcaccctggaagacagtagatgatggatctgttatgaggccccatcaccaagaagggaacactgatgcagttccatgatcctgggttccagctgccaaaccttgagtacactgcctttatttatcatctccataaaacattggcaaacacaacaccagtattcagagatctgaatcttcatgactggccattgttcatccttttatcccatgtaggtagcatcacatattatgtgtcttcctggcctggatgcttagcagagtgtacttttactgacatattatcctaggcacattattctccgggatcatccaagttgtccaaaattacagaatttcttactctgtactgcttgtaaccttccttttaaaatgtaactttgtccatttctttcattttccattcttgctttcatgagatgtcactggatcacatgtgtgaactcttttgaatgacggtgctttaaatgaacaaggaactgcagaggtgtttgccacagtgactgtagattccgtggacacctccctgggatttcatattcattgtaccatgcaatggtgcttgaagatcatgtaataattctgtttctagtttttgatgcttttccataatggttttactaattaacctgacacagacttgtaccagggttatcatctctctctacctccataaaacatgtcagctctggtatgtctgataatagccattctaataggaaggatgcgatgtctcgttgtgcttctaacatggacatacatgatggtcccagatttgtagcattttatatgtttgtctttatatcttcttttaaaatttataggtgtaccataaattttaaaatttatcattttatttaaaaatttgtctttatgtatttgtccaaaaccacaaagagactgagactgacagtgatcttctaactcctgggtcacttccccaatggctacaaaagcttcagctgggtcaggtgacagccaggtgcttggaattctgtccagggctcccacgtgggactacttggaacttcacctacggcctcccagaggggcttaggaaggaatatgacactggaaccaaactaggacacagcactcagcatcctcatacaggagcaggaatccatcaggctcactccagtgctgctcctgtcaccaccttatcatcactgcatttaaggaattgatttcttcccttgggattcagttacttgagatctttgaacattaggaaataggctcctaatcatatgtataatcttcaatttattttaagtatctattttattttagagacagtgttatagcaagagatgaagagaccaacggatggagagagaagcttctgtccagtggttcactttgtgaatggctgcaaaggctatgatggctgagcaagaaaccaggagcctggaacttcctctagtttcccacagggctggaaggggacaaacacttgggtcatggtagacagtgatcaccattgcaatgcctacctctgtgagttcaattgtggactgcatatacaaataatgtcacatactatgtgtccacatctacctggattatatcttttagtatgtatactccaagctgacccatgtttcctactgacagaacgacctccttcttaacactgaataatatccatgtccaagtgttaaagaatccattcactgttttatgcgcacttgttctttgtagactgaactattgggaacacagctgcattacctgaacccaggactacgggtgaattgtgacacagtgacttctacccagtgcttgagctgaactcagagccatgattacagaacagggaagagggggaacacagggcagctgataacaggacacaaagcaccactcacaggaaggaataattctgcccacaccacagtgggctgactcagttcaccacaacacacgacaggttccacaaataactagaactgaggtctccaggcctcccaacagagtgatggaaaggaggtggaaatgtgcatgacactgagttcatctgtgcccatttctaccatgcacattccaggagcacataaaccccactaccatgtacagtgttctgtgttcaggaacagttttaaactaaggcaatggatgaataaatgaacaacacatagttaaccttaaaaaatccacttcagtctttcatctatttaaaagttggtgacaggcactaggacaaaattggctaagtccccactagggacacccgtgttcccatcagagaactgactgagcctagcctcacggcttcccacacttttccctcataatgcaacatgggaacctgtagatgacgctacaagcaaaggagcccctaccaccaacgtttgaattacagacacagtttcttgctccagggttcagaaagactaactcctaggggtcataggcatttgggatgtatggggctgtcaacccaaaggcagaaatctcccattgtcacaatttctgtccaactctacatttctgtaactctcaccccttctctctctatctctgtcccaatgtctttcatatagatgataaggaactaaaggttatttaaataaatgaggaacatgatattgctaacactggatattaagggtacacattgaattaagatgaaataatgtatttgtcttcaactttttaaaataatgataacataaaaattcacatgatctgaattttatcacagccatcagcgtacacccccaggtcaccacatctgccctgggccctgtcctgtctgaggcatctgaccccatgcctgttattagcagcagcacatgcaaatggggcctccctctgcccatgaaaaccagcccagccctcaccctgcagctctggcacaggagctccagccccaggactcccaggtgtccactcagtgatcgcactcaacacagacgctcaccatggagactgggctgcgctggcttctcctggtcgctgtgctcaaaggtaatgatggagaacgcggggcactgagtctgggagaggatgtgagtgagagacacagagagtgtgagtgacagtgtcttgaccatgtcgtctgtgtttgcagg

SEQ ID NO: 33 - DNA, 2920 bp, Oryctolagus cuniculus
cacagtgaggggccctcaggctgagcccagacacaaacctccctgcaggggcgcgcggctccaccagggggcgcacaaaacgcactgagcccagattctggtcctgcacaggcgcagagtgagaccaagccctggtttcctgtcagggatttagggtttcctctcctgtaacagttttgagggaagaattctactttttgattctgtccctcccaacttcaatgacggattgaaagtttgatgtaaaaggaagaagtcctaaatgaacaatttggatcatggacagcgactgtgctcaccaggatcagagatgtgggaatattgaggacactattgagtctcttccaacctgactcaggacagcaccctcagggcactgaaagctttggacagtttcagttttccctgtataaccagggacagctgagacagggtcgttgatctgttaacagcaactattccactcatccctctcctgccacaaccagcaagtgtgcactgaaccaacctttgactttacatgtgggtgatccacactcactttctgcagactttaacccgacctgcatttccctttaatcctgaaacagtctgtggtccctgtgtgaatgtcacagcactcaggactgtacttgcagctcagctgtgtctcaggctgagcttctgcaggcacctgggaagcctacagggacttcctcatcctctaggtcctgggaccctcctgggggctccctgcatgaactcaggagggaaatgcgatggacatcagcggtcaaggtcatcactgaatggaaagtgttgggtgtgcacttccagctgatctggttctgtcaagtgtcgtgggaacccctgcacctgctgtggttcagggagagcagaaagtgggacacacagaggctgtgcactctggggctggagtccacatcacggggagctgtgtctgtggctccagcatgatgcccagtgtcctgaggctgaatcacagctgcaggaagagagagtcccagagaccatgtgtccagagtccctgctcttcactccatgtttgtgctgactggggtcatcaatttatttggagtctttcattaatattacaggctgcatatcagagtcctggacggagcccatttacacattcaccacacttgtactgacaatgcaccctggaagacagtagatgatggatctgttatgaggccccatcaccaaggttggaacactgatgaagttccatgctcctgggtttcagctgccaagccttgagtacaatggcctttatttaccatctccataaaacattggcaagcacaccagtattttccgtttttgccgtttcatttttataaatgttttataaataataattggatatagacatatgaggtgcaaggatatgtgttcaaaattgaatgtagcaaattgatggaattatgaagtcattcttattgacatgctcatcacaaaatccacatgttcccatggtagattgtcagttgtcttctgttttggaattctgtagacacaatatttgcttaactgctgtcaccatgctgtacagtagatccctcaacatgtggatcctgtgggactgaaactctgaccttgctccaatgtctcctctgttccatgcccttttcttccattattgattccttcttccatgaaaatttcactggattatatgtgtgaacactcgtgaacgacgctgctttaattgcacatggaactgcagttgtagtttctatagagactgtgaatcccatgcacatctccctgggatttcacattcctgctacccaaaatgctgtttgaagatcctgtgataactgtatgtctcagtttttgatgactttccataatggatttactaatttacctgactccagccttgtacaaccagagtggtcatctctcttccttcacaagaattgtcagctctggcttgtctggtaatactcattctaacatgaaggatggacatctcattgtgcttctaaaatgtgcatacatgatgatctcagatttatggcattttacatgtttgcttttatatcatttcttaaattttatagatgtaatctacagttaaaaattcatagattttattttaaaatttgtctttatgtatttatctaaaaccacaaagagactgagactgacagtgagattctatctcctggtcactaccaagagggctacaaatgcttcagttagatcaggtgacagccaggggcttggaattctgtcaggtctccacatgggagtacttggaacttcacctatggccacgagaaccaaactaggacacagcactaaagaacctgattcgggggccggcgccgcggctcactaggctaatcctccgcctttcggcaccggcacaccgggttctagtcccggtcggggcgccgtattctgtcccggttgcccctcttccaggccagctctctgctgtggccagggagtgcagtggaggatggcccaggtgcttgggccctgcaccccatgggagaccaggagaagcacctggctcctgccatcggatcagcgcggtgcgccagccgcagtgcgacggccgcggcggccattggagggtgaaccaacggcaaaaggaagacctttgtctctgtctctctctctcactgtccactctgcctgtcaaaaaaaaaaaaaaaaaagaacctgacacaggaggcagcaatcccacatgctaactccagtgctgctcctgtcaccaccttatcagtcactgcatttaaacaattgatttcttcccttgggattcacttctctgtgtttattcaacatttgcatataggctcctaatgatatggataattaatctttcatttattttaatatctatttattttgtttgaaaggcattgttatagcaagagaagaagagaccaacagatag

SEQ ID NO: 34 - DNA, 4399 bp, Oryctolagus cuniculus
gacacagtgaggggccctcaggctgagcccagacacaaacctccctgcaggggcgcgcggctccaccagggggcgcacaaaacgcactgagcccagattctggtcctgcacaggcgcagagtgagaccaagccctggtttcctgtcagggatttagggtttcctctcctgtaacagttttgagggaagaattctactttttgattctgtccctcccaacttcaatgacggattgaaagtttgatgtaaaaggaagaagtcctaaatgaacaatttggatcatggacagcgactgtgctcaccaggatcagagatgtgggaatattgaggacactattgagtctcttccaacctgactcaggacagcaccctcagggcactgaaagctttggacagtttcagttttccctgtataaccagggacagctgagacagggtcgttgatctgttaacagcaactattccactcatccctctcctgccacaaccagcaagtgtgcactgaaccaacctttgactttatatgtgggtgatccacactcactttctgcagactttaacccgacctgcatttccctttaatcctggaacagtctgtggtccctgtgtgaacgtcacagcactcaggaatgtactgcagctcagctgtgtctcaggctgggcttctgcaggcacctgggaagcctacagggacttcctcatcctctaggtcctgggaccctcctgtgggctccctgcctgaactcaggagggaaatgcactggacatcagcagtcaaggtcatcactgaatggaaagtgttgggtgtgcacttccggctgatctggttctgctccagtgtcatgggaccccctgcacctgctgtggttctgggagagcagaaagtgggacacacagaggctgtgcactctggggctggagtccacatcacagggagctgtgtctgtgactccagcatgatgcccagtgtcctgaggctgaatcacagctgcaggaagagccagtcccagagaccatgtatccagagtccctgctcttctctccatgtctatgctgactggcgtcatcaatgtattttcagtctttcatcagttttagagagggagacacccaggctgcatatcagagtcctggacagagcccatttacacaataccacacttgtactgacaatgcaccctggaagacagtagatgatggatctgttatgaggccccatcaccaaggtgggaacactgatgcagttccatgctccagggttccagctgccaagccttgagtgcactgccttcatttatcatttctataaatctccatatatacttccttttaaatataactctgtccatttgtcccattatccattccttcttcaatgctaatttcactggattatgtgtgtgaactcttgagaatgacgctgctttaattgaacaggggactgcagagatgtttgtcacagtgactgcacatcccgtggtctcctccctggatttcatattccttctacccaggcatggtgttggaggatcctgtgataattctatttctcagcttctgatgttttccatgaaagctttcctaatttacctgactccagcctttaccaggttatcatctctctcttcctgcacaacatgtgtcagctctggtatgtctggtgatactcagtctaagaaagggatggggtatctcattgtttctccaacatgtacgtgcatgatgatcccagatttaaagcatttttatacatttgcctttatatattttattttaaaaattacagatacactttcacctcttttaaaacttgtatttgtgtatttgtccaaaaggaaaaagagacagagactgacagacagtgatctactgaatcctggtaacttcccagatgcccataaaagctgagttgggtcagatcatacaggtgcatagaactcagtccaggtctcacacatgggataaactcagacttctcatactgcctcccagagtgcacattggcaggaatctgaaattgggatctaaactgggacataaacctgagcatcctgatgcaggaggcaggaatcccacgtgataccctcaatgctgctcctatcacccaccttgtcagtcactgcatttaaaccattgattgcttcccctgtgattcagttgcttgagttcattcaacatttggatctaggctcctaatcatatgtacaattatctttcatttattttgaatatctatgtatttgatttgaaaggcagtattatagcaagagaggaagagaccaacagagggagagagaagcttccatccactggtttccttcctgaatggctgcaaaggctgggcaagggcaagactgtagccaggagcctggaacttcctccagtttcccacagagctcgaaggggacacacacttgagtcatcgttgacagagttctctggtccatgagcagggagctggatttgaagtgcagcaagcaagatctgaacccatgctgctgagtgaagctgcatagggatggcagcttaacctgtggggccacaatgttggggagtaggccatgagggttgctgcctgcattgaagggaatacgacccttagaaagacccttcaggccggcgccgcggctcgccagactaatcctctaactgcagtgccggcactccgggttctagtccaagttatggcgccggattctgtcctagttgctcctcttccagtccagctctctgctgtgacctgggagtgcagtggaggatggcccaagtgcttgggccctgcaccctcatgggagaccaggaagaagcacctggctcccggcttcgaataggcacagcgcgctggtggaggcggacatttgggtgataaaccaacggaaggaagacctttctctctgtctttctctctctctctatctctgcctgtcaaaaaaaaaaaaagaaagaaagaaaagaaaagaaagtaagacccttcagtaacttaatttttaaatttgagttataacacatgaatcagagaggagaatgagagaaagagagatgttccgacactgtgctttcccaaatgttgctgtggccaggtctgcttcccagcttagcccggtctcaggaaaacaatcaggtgcatccacaagcgtgacagggcccaaaattcctcccataaacttctgggtcctggggctgcaggagcaggaaactggtactgggagccagagccacacatgggaccctggcactctcttgggggatgtgctcatcttaaacagtgcaaatttcaatttattatttcctttatttccatgaaatttgatgcactcagatgcacctacgtgaaacctggtcctctgtgcatctctctgttaaaaatggaatccagcaaaagtgctccttgttctgctgctggcagggagttctgcagacctcaccaggaagccccagtgagtgctaagggtggactggggcagagctgagtcctgtggtgaggggcatggatcaaggtgctggggactcctcttaccacactggagtggggacacatccacactgtactgatgatttctcctgtaacgttgaaatggaccaagacctaagggaacccatgaatacacattgtaggtccattcacataaaaggaccaagagagggttcagtgtgcaatgagagcatacaatttatcactcatcccacatatgaataatgtcagactgccccgggacactctcatcagtctggacactatcatactaaggagtctgacgccagggctgctatataggggcagcacatgcaaatagggctccctctgcccatgaaaaccagcccagccctcactctgcagctctggcacaggagctccagccccaggactcccaggtgtccactcagtgatcgcactcaacacagacgctcaccatggagactgggctgcgctggcttctcctggtcgctgtgctcaaaggaaatgaagggccagtgcccgagctcactaggctaatcctccgcctttcggcgccagcacacagggttctagtcccggttggggcgctggattctgtcccggttgcccctcttccaggccagctctctactgtggccagggagtgaagtggaggatggcccaagtacttgggccctgcaccccatgggagaccaggataagtacctggctcctgccatcggatcatcgcggtgagccggcctcagtgagctgacacggtgaccattggagggtgaagcaacggcaaaggaagacctttctctctgtctctctctctctcactgtccactctgcctgtcatataaaaaggtaatgatggagaatgcagggcactgagtttgggagaggatgtgagagagagtgtgagtgacagtttcgtgatcaggacgtctgtgcttgcagg

SEQ ID NO: 35 - DNA, 4731 bp, Oryctolagus cuniculus
cagagtgaggggccctcagtcagagcccagaagcgaacctccctgcaggggagtgcggctccaccagggggcgcgcaagacacactgagtccagattctggtcctgctcaggcacagagggagatgaagccctggtttcctgtcagggatttgggtttcctctcctacagttttgagggaagacttctacttcaggattctgtcccttacactgacgccactgacgtagagaagctttatgtgacaggaagaagtcttaaatggacacattcaggtttgtgaacgatgacagtggtcaccagggtcagagatgtgagacaatcaggggacctcgtgagtgttgtccagtctgactcaggacagcgttccaggacactgccgactataagacaattttagttttccttcaaacccagacagacccgagccagagtcttgatttgctacctcagttttataagtcgtcccatcctcctgtcagagcagcctgtgtgctgcactgaaccaaccgtcttattttaactgtgggtgttctgcattcactttctacagactttatacccaatctccatttccctttaatcctgaaacagtctgtggtccctgtgtgcacttccagctgatctggttctgctccagtgtcgtgggaacccctgcacctgctgtggttcagggagagcagaaagtgggacacagagcggctgtgcactctggggctggagtccacatcacggggagctgtgtctgtggctccagcatgatgcccagtgtcctgaggctgaatcacagctgcaggaagagccagtcccagagaccatgtgtccagagtccctgctcttcactccatgtctatgctgactggggtcatcaatccatttgtgttctttcatcagtattagagagggagacacccaggctgcatatcacattgctggatggagcccatttgcacgctttcccatacttgtactgacagtgcaccctggaagacagtacatgatggatctgtatgaggccccatcaccaaggtgggaacactgatgcagtttcatgctcctgggttccagctgacaagcttgagtccactgcctttatttatcatctccataaaacatggccaacacaacaccagtattcaaagatcaatcgtcatgattggccatcgttgctatttcatattcctaaatgtttgataaataatattgagtatagctctatgaggtacaatgatatgtgtggacaaaatgaatgcatattgagtggaattatgaagtcaggcttgatgacacattcataccacaacacatgtttttggtggagttcacctgtctcctgctcttaagagatttccactcacaatattctcttaacctctgtcaccatgctgtgcagtagatccctcagtgtgtggagcctgtgggactaaaactctgaccttgctccagcgtctcctctgttcctccctcgctcagactttggtcttcaccattgtacttcctgcctctgtgccttcagccttttatcccatgtaggtagcatcacatattatgtgtcttcctggcctggatgcttagcagagtgtacttttactgacatattatcttaggcacattattctccgggatcatccaagttgtccaaaatcacagaatttcttactctgtactgcttttaaacttccttttaaaatgtaactttgtccatttctttcattttccattcttgcttccatgagatgtcactggatcatatgtgtgaactcttttgaatggcggtgctttaaatgaacaaggaactgcagaggtgtttgccacagtgactgcagatcccgtggacacctccctgggatttcatattcattgtaccatgcaatggtgcttgaagatcatgtaataattctgtttctagtttttgatgcttttccataatggttttactaattaacctgacacagacttgtaccagggttatcatctctctctacctccataaaacatgtcagctctggtatgtctgataatagtcattctaacaggagggatgggatgtctcattgtgcttctaacatggacatacatgatggtcctagatttgtagcattttatatgtttgtctttatatcttcttttgaaatttatagatgtaacataaattttaaaatttatcattttattggccagcgcatggctcactaggctaatcctccacctgcggtgactgcaacccagtttctagtctcggtcgggcgccggattctgtcccggttgcccctcttctaggccagctctctactgtggcccgggagtgcagtggaggatggcccaagagcttgtgccctgcaccccatgggagaccaggagaagcacctgactcctggcttcggatcagcgtggtgcaccggttacagcggccattggagggtgaaccaacggtaaaggaagacatttctctctgtctctctctctgtcactgtccactctgcttgtcaaaaaagtgtaccattttatttaaaaatttgtctttatatatttgtccaaaaccacagagagactgagactgacagtgatcttctaattcctggtcacttctcagatggctaccaaagattcagctgggtcaggcgacagccaggtgcttggaattctgtccagggctcccacgtgggactacttggaacttcacctatggcctcccagaggggcttaggaaggaatatgagactggaaccaaactaggacacagcactcagcatcctcatacaggagcaggaatccatcaggctcactccagtgctgctcctgtcaccaccttatcatcactgcatttaaggaattgatttcttcccttgggattcagttgtttgagatcttcaacattaggaaataggctttcaatcatatgtataattaatcttcaatttattttaagtatctattttattttagagacagtgttatagcaagagatgaagagaccaacagatggagagagaagcttctgtccagtggttcacttcgtgaatggctgcaaaggctatgatggctgagcctaaagccaggagcctggaacttcctccagtttcccacagggctggaaggggacaaacactttggtcatggtcgacagtgatcaccattgcaatgcctacatctgtgagttcaattgtggactgcatatacaaataatgtcacatactatgtgtccacatctacctggatcatttcttttagtatgtatgctccaggctgacccatgtttcctactgacagaacgacctccttcttaatactgaataatattccatgtccaaatgtgaaagaatccattcactgttctgtgaacacttgcttaattgtagactgaactattatgaacacagctgcattacctgaacccaggactgcgggtgaattgtgacacagtgacttctacccagtgcttgagctgaactcagagtcatgattacagaacagggaagagggggaacacagggcagctgataacaggacgcaaagcaccactcacaggaaggaataattctgcctacaccacagtgggctgactcagttcaccacaacccatgacaggttccacaaataactagaactgaggtctccaggcctcccaacagagtgatggaaaggaggtggaaatgtgcatgacactgagttcatctgtgcccatttctaccatgcacattccaatagcacacaaaccccactaccatgtacagtgttctgtgttcaggaacagttttaaactaaagcaatggatgaataaatgaacaacacatagttaaccttaaaaaatcaacttgcagtccttcatctatttaaaagtgggcagcaggcattaggacaaaattggctaagtccccactagggtcacccgtgttcccatcagagaactgactgagcccagcctcacggcttcccacacttttccctcataatgcatcatgggaaactgtagatgacactacaggcaaaggagcccctaccaccgacgttggaattacagacacagtttcttgcttcagggttcagaaagactaactcctaggggtcataggcatttgggatgtctagggctctcaacccaaaggcagaaatctcccattgtcaccttttctgtccatctctacatttctgtaactctcaccccttctatctctatctctgtcccaatgtctttcatatagatgataaggaactaatgggatttaaataaatgaggaacatgatattgctaacactggatattaagggtgcacacatattaaaatgaaacaaggtatctgccttcaactttttaaaataattataacataaaaattcatatgatctgaatcatatcacagccatcaccgtacacccccaggtcaccacatctgccctgggcgctgtcctgtctgaggcgtctgaccccatgcctgctatataggggcagctcatgcaaatggggcctccctgtgcccatgaaaaccagcccagccctcaccctgcagctctggcacaggagctccagccccaggactcccaggtgtccactcagtgatcgcactcaacacagacgctcaccatggagactgggctgcgctggcttctcctggtcgctgtgctcaaaggtaatgatggggaacgcgggacactgagtctgggagaggatgtgagtgagagacacagagagtgtgagtgacagtgtcctgaccatgtcgtctgtgtttgcagg

SEQ ID NO: 36 - DNA, 32460 bp, Oryctolagus cuniculus
gacacagtgaggggccctcaggctgagcccagacacaaacctccctgcagggtcgcgcggctctaccagggggcgctcaagacgcactgagtgcagattctggtcctgcacaggcgcagaagatgaagccctggtctcctgtgagggaattggggtttcctctcctgtagcagttttgagggaagaattctactttttgattctgtccttcccaacttcactgacggagagaaagtttgatgtaaaaggaagaagtcctaattgaacaatttggttcatggacagcgactgtgctcaccagggtcagagatgtgggaatattgaggactctattgagtctcttccaacctgactcaggacagcaccctcagggcactgaaagctttggacagtttcagttttccctgtataaccagggacagctgagacagggtcgttgatctgttaaacagcaactattccactcatccctctcctgccacaaccagcaagtgtgcactaaaccaacctttgactctacatgtgggtgatccacactcactttctgcagactttaacccgacctgcatttccctttaatcctggaacagtctgtggtccttgtgtgaacgtcacagcactcaggaatgtactgcagctcagctgtgtctcaggctgagcttctgcaggcacctgggaagcctacagggacttcctcatcctctaggtcctgggaccctcctggggggctccctgcctgaactcaggagggaaatgccctggacatcagcagtcaaggtcatcactgaatggaaagtgttgggtgtgcacttccagctgatctggttctgtcaagtgtcgtggcacctcctgcacctgctgtggttcagggagagcagaaagtgggacacagagtggctgtgcactctggggctggagtccacatcacggggagctgtgtctgtggctccagcatgatgcccagtgtcctgaggctgaatcacagctgcaggaagagccagtcccagagaccatgtgtccagagtccctgctcttcactccatgtctatgctgactggggtcatggatccattcggagtctttcatcagttttagagagggagatagatacacaggctgcatatcagagttctggacagagcacatttacactatttctatacttgtaagtgaaaatgcaccctaaagacagcagatgatggaccagttatgaagccccatgaacaaggtgcaaacgctattgcagttccatgctcccgggttccagctgccaagcctcaaattaactggcatttatttatcatctacataaaacactgagaaacacaacaccagtattgagcgaactgaatctgtagttggccattttgtcattttattttcataaatgtttgataaataataattgaacatagacatgagataaatgatatgtgttcaaaaatgactgtatcaaattgatggaattatgaagtcattcttattgacatgctcatcacaaaatccacatgttcccatggtcgaatgtcagtggtctcctgttttggaattcaatagacccaatattcatttcactgctgtgaccatgctgtacagtagatcctcagtgtgtggttcctgtgggactgaaactctgaccttgctccagcatctcctctgttcctccctcactcagactttggtcttcaccatcgtagttcctgaatctgtgagttcatccttttatcccacgtaggtagcatcacatattatgtgtcttcttgactagatggtaatctgtacatttactgacacattatccttaggcattattctcagcattatccaagttatccaagacatcagaatttcttcctctttactgccttataaacttcatgttaaaatataactctgtccatttgtcccattatccatccttcctcaaggctaatttcactggattatgtgtgtgaactcttgagaatgacgctgctttaattgaacaggggactgcagagctgtttgccatagtgactgtggatcccatggtctcctccctgggatttcatattccttcttcccaggaatggtgttggaggatcctgtgataattctatttctcagcttctgatgttttccatgaaagctttcctaatttacctgactccagcctttaccaggttatcttctctctcttcctgcacaacatgtgtcagctctggtatgtctggtgatactcagtctaacaaagggatggggtatctcattgtttctccagcatgtacgtgcatgatgatcccagatttaaagcatttttatacatttgcctttatatattatattttaaaaattacagatacactttcacctcttttaaaacttgtatttgtgtatttgtccaaaaggaaaaagagacagagactgacaacagtgatctagtgaatcctggagcacttcccagatgcccataaaagctggcatttggtaagaccatagccaggtgcatggaattcagtccaggtctcacacatgaaattaactcagacttctcatactgcctcccagagtgcgcattggcaggaatctgaaattgggatctaaactgggacataaacctaagcatcctgatgcaggaggcaggaatcccatgtgataccctcaatgctgctcctatcacccaccttgtcagtcactgcatttgaacaactgattgcttcccctgtgattcagttgcttgagttcattcaacatttggatctaggctcctaatcatatgtacaattatctttcatttattttgaatatctatgtatttgatttgaaaggcagtattatagcaagagaggaagagaccaacagagggagagagaagcttccatccactggtttccttcctgaatggctgcaaaggctgggcaagggcaagactgaagcaaggagcctggaacttcctccagtttcccacagagctcgaaggggacacacacttgagtcatcgttgacagagttctctggtccatgagcagggagctggatttgaagtgcagcaagcaagatctgaacccatgctgctgagtgatgctgcatagggatggcagcttaacctgcggggccaaatgttggacaacccatgtgtgacctgaaaatgctttctccccatctgtggttgtctttggttcttcaattactccctttgttacacagaagctctgtggttggatccattatcttttacctatttttgctaggttgcctgtacattggagattatcaaaataccattgcccaaaccaatgtcagcttgcttttgtccagtgttttcttctagatctttactgtctcaggtcttgccttgaaggcattcctcaagttcactctgtttctgtatgtggcgtgagatgaccacataaatgaattattttcaggtgcattcaagtgtccccaaccccaggtaacgacaggaaactcatccccatcctgtacttttgtcaccatgtttgcattcagttttctgagaatgtgtccttcatttttaggtttctattctgtcccagggctctgggtgtctattgttatcccagcaccagacttgatttcagctcagatatgatgaagcctcctgctttgccatcacaaaccctgattttcttcatgtgagatctagaattttcttccttttcctagaaataatgtcaggctatttcacaggaaatgcattgaatctgtgaatcatgttgtagcttggctattttaacaagctcatatcttcaaatccatgactacgtcattccaatttacagggaatcatcaaattccttttcactttttaaattattatgtattgcagaagtatgagtgaagacccctatcttacaccttacacaaaactccactcaacatggattaaaaatataaatctatgaccctacaccatccagttattagagaacatttgtgaaaccctgcaagatactggcacaggggggttcgggaagatggcggaatagggagggagcacaccgatggtctgggaagggaaggttcaaagagggttgagaatttgtagtttcggggaaagggaagctcttccaaaactggggagacagggtggacctgcgaggaggatgtggatgtctgaagcgcaggacaccagcaggagtgtgtacgcaccagcgctggaagccgaggtgagacagggcgctcgcccagcaccactgcaacagccgctgccgcccctcccccaacccactctgggacggacactgagacatgcacgactgagtgggggaggaaatagaaaacggaacagagtgagtagcgcctgcggaaagagtgcgcgattcagggggactaattgagggactaaacaagctaggatcccttggtgcctccaccctcccccaaataggagctgcatcgggcaggaagcagccatcttgtttgtttacattcgggcttaaaggagaactgcctctgcctctgcattaacctttggaggcggagcccaaaggtggagtggagtgacaggacactccttgcgcaggggcgggcagcaagggagggcagctcaaagccctgacaccagtctattcaagttaccagaaaaaaaaaaactgaataacacccgcgggaacagggcagcatccagggggatgaactgagggatcaaaaacgccaggatccttaggagaagcccaacccacaatcagagctgcagtgggcagagagcagccatcttgtttgtttacattcggtttaaaggaggctggcctctgctctgaaggaggaagcagcaggggcggagtccaaaggtggtctggagctacttgacactcctcatgcaggaggtgcagtgagagagagtggctgaccaaggatccccaggcacagacacataagggcgaacataggaacaaggaaaccggcccccaaggggcggagattagcacctcaaagccctgacaccagcccactcaagttataaaaaataaataaataagtaaaaaataaacaaacaaactctagaaggcagagcagcctgcttatactggatattggtacagactcacagcagcccatagcagagggaaatcaacctgaaaaaccacccagacggaatgccaaaaaaacaaaacaaaaacccacaataagaatatagaagaacatataaactcaccaatggagcaggctaaaccaaccataacagaggctgaagaagaataatttgaaactatgacagaaaaagaattcagaaaattaataatcagaatacttagaaataatgagaaacagtgtcgagagctgaacaaaaaacaagcccaaggattagagatcctaaagagaagccagaatgaaatactggaaatgaaaaactcaattgaccatataaaaaacactgtggaatccctcagaaatcgaacagatgaaatagaagaccgaatatcagaattcaaagacaaacttccagaaataatacagtcagttcaaacacaggaagaagaaattaaaaaatatggtcggagacctacaagattcaatcaaacggtgtaatgttcagataataggagtccctgagggggtggaaagagagattggattggaaggtgttttcaatgaaataatatcagaaaacttcaaacaaaggcagctggataacaacaggcaaattcaacatatagccaggactctgaacagggtagaccagaagagaaattcaccgcgacacattgtggcaacactcagctcagtgacatacaaagaacaaatcctaaaatgtgccagagaaaaatgacaaatcacattcaggggtaagttaatcagactcaccccagacttctcatcgcaaacactacaggcaaggagacaatggcatgatatatttcaagttttaaaagacaaacagtgctaacctagaatactataccctgcaaagctatcatttatgaatgaaggggaaataaagatcttccaagaaaaacagaaactgaaagaatttgtatccatgcgtgcaaccctacaacacttgctcaaagacacgctgcacacagaaatacaaaaacaagaacttcactacaaaaaaagcgaatgtagagtaacctacaaacaaagttcaaaatacataaacagctcatttcaggaaacacgaatgggaaaagacagtacttaacagtaatcacactgtatgtgaatggtcttaattctactaccaaaagacatagactagctgattggatcaagaaagagaatccatctatatgctgccttcaggagacacaccttatcagcaaagatgcacacagactgaaagtgaaaggatggaaaaagttactccaagctaacagaaatcaaaaaagagctggtgtgaccatcctaatatcagacaaaatagactttaacataaaaactattaaaagagacagagaagggcactatataatgattaaaggatctatccaacaggaagacattactattataaatgtatacacacctaattacagggcacctggctacctgaaagaattactaaaggatttaaagggagatataaattcgaatacaatagtaacaggggacttcaacaccccactctcaccaatggacagatcaaccagacagaaattcaacaaggaaacaacagagctaattgacgctatagaccaaatagacctaatagatatcttcagaaccttccaccccaaagacacagagttcacatatttctccccagtacatggaacattctctaggattgaccatatggtaggccataaagggagcctcaacaaattcaaaaaaattgaaactataccatgcagcttctcagaccatagcacagtgaaactcgaaatcaacaacccaagaatctctacatcatatgcaaatatatggagaatggacaacatgatcctaaatgaacagtgggtcatcgaagaaattaaaagagaaatcaaaagatttctagaaacaaatgaaaatgataacacaacatatcaaaacctgtgggacacagcaaaagcagtgctaagaggaaagtttatagcaactggtgcctatatcaagaagctggaaagaaccaaacaaataaactctccatgtacctcaaggatttagaaaaacagcagaaaatcaagcccaaatccagaaggaggaaagaaatactaaagatcagaaaagaaataaacagaattgaaacaaaaaaaaaaaaacaatacaaaagatcaacaaaaccaggagctggttctttgaaaaaataaacaaaattgacataccattggcccaactaaccaaaaaaaggagagagaagacccaaatctgtaaaatcatgataataatggaaatgtaacaacagacacaacagaaataaaaagaatcatcagaaaccactacaaagagatgtatgctaacaaattggggaacctggaagaaatggatagattcctggacacatacaaccttcctaaactgagccgtgaagatatagaaaatctaaacagacccataaccatggaagaaattgaatcagtaataaatgcaagagcgaaaaagaatagcccaggaccggatggcttcaccgccgaattttaccagacatttagagaacaactaaccccagttcttctcaaattattcaaaatgattgaaagggagggaatcctcccaaattctttctacgaagccaatatcaccttaattcctaagcccggaaaagacacaacagagaaagaaaactacagacctatctccctgatgaacatagatgcaaaaatactcaacaaaattctggcaaaccaaatccaactgcacatcagaaagatcattcacccggaccaagtgggatttattcctggtatgcagggatggttcaatatttgaaagtcaatccatgtaataaatcacattaataaattgagaaacaaaaatcatatgattatctcaatagatgcagagaaagcatttgacaaaatacaacaccatttcatgatgaaaaccctaagcaaattggggttagaaggaacattactcaacacaattaaggcagtctatgttaaaccaatggccaacatcatattgaatggggaaaagttggaggcatttccattgaaaactggaaccagacagggatgcccactctcaccattgctattcaatatagtcctagaagtgttagccagggccatcaggcaagaaaaagaaattaaagggatataaatgggaaaggaggaagttaaactatccctatttgcagatgacatgctactatatataggggacctgataaactcctataagagactactggaactcatagaagagtttggtaaagtagcaggatacaaagtcaatgctcagaaatcaacagcctttgtatacacagataatgccagggccgagaaagaacttctgagatcaatcccattcacaatagccacaaaaacaataaagtaccttggaataaatttaaccaaggatgtcaaagacctctatgatgaaaattacaaaacactaaagaaagaaatagaagacgacacaaaaaaatggaaaagcctggcatgctcatggattggaagaatcaatatcatcaaaatgtccattctcccaaaagcaatttacaagttcaattcaataccaatcaaaataccaaagtcattcttcaaagacctagaaaaaaatgatgttgaaatttatatggagaaacaggagacccagaatagctaaagcaatcctttacaataaaaacaaggccagaggcatcacaattccagacttcaagacatactacagggcagttataatcaaaacagcctggtactggtacagaaacagatggatagaccaatggaacagaatagaaaaaacaccggagaacaatccaaacatctataacaaactcatattcgacaaaggacctaaaaccaacccctggaacaaggacagcctcttcaacaaatggtgctgggaaaactgatgtccacatgttgaagtatgaagcaagacccctaccttacaccttatacaaaaatccactcaacatggatcaaagaactagagttgcgccacgacaccatgaaactaattgagagcataggggaaacccttcaagatatcggaataggcgaagaattcctggagaagaccccagaggcatgggtaatcaaagataaaataaacaaatgggattacctcaaattgaaaagtttctttacagcaaaggaaacagtcgggaaagtgaagaagcaaccaacagaatgggagatgttattcacaaactacacaaaagataaaggattaacaactagaatctataaaatgatcaaaaaacaccacagaatcaaaacaaacaacctaataaaaaaatgggccaaggaccttaacagacatttttcaaaagaggaaatccaaatggccaacaaacacatgaaaaaatgctcaggatccctagccatcagggaaatgcagatcaaaaccacaatgaggtttcacctcactctggttagattggcttatatacagaaatcaaccaacaacagatgctggcgaggatgtggggaaaagggacactaatccactgttggtgggaatgcaaactggtaaagccactgtggaagacagtttggaggttcctcagaaacctgaatatagcacttccacaggacccagccatcccactccttggaatttacccaaatggaattgaaggggagaaaaaaagagccatttgcacctcaatttgttgcagctcaactcacaatagctaagacatggaatcaacctaaatgtccatcaacagatgactggataaagaaactatgggatatgtactctatggaacactatacagcagtaaaaaacagtgaaatccgggcatttacaacaaaatggaagaatctggaaaacatcatgctgagtgaaataagccagtcccaaagggacaaatatcatatgttctccctgattgatggcaactaaacgagcatctaaaatgatacccattgaagtgaaatggacactatgagagacaatgacatgatcagcccttgtctagactgttgaggaacaacttactattttattccttttagtatttttgttgttgttgttgttgttgctatgtttattctacgtaagaccactggttgaactctgtaatcaatgcacaatcattcttaggtgtttaaaattaacagaaaagtgatctctgttaaacataggagtgggaataagagagggaggagatatataggttggcacatgctcactcggacttacctccaatggtggaactagaaatgtgccaggggatttcaactcaatcttaccaaggaggcaggtaccaatgccaatgcacttgataaagtgataagtataaatacacaactgatcaaaaagatagggtatgtgtcgaagagatttcacaaataagaccagtgtaagcaaataatgaaggatagaattaaaagggagagaatgatcctgcgggggaagcaggacacacagcagactcatagaatggcaaatgctcaaaacagcactcctgcctcagaatcaacccttgggacattcggatctgactaaaaggtccacgagagtctcacaggcatggaaagccatgacacggtgacaaaaagaaacctaaatgaaagatcctggtgaacaagaccccagcagaaggaacaggccatcaaggagagaggcgcctttctctgaagggaggaaggaacctctactgtgatactgccttgactaaacaagttcagagttggtgaactcaaggggcttccatagcctagacagctcatagcaagagtctcaggtgattgctgacgtcataaataagagtgccaattgttaaatcaacaacaggagtcactgggtacatgctccccacgtagaatttctgtccttaatgtgttttactatgaaacttaaaaacaacactactagtcgaacaataccctataccttgtgtggttgtgtgagtgcagcctgttgaaatccttgcttagtatgtactaagttgatcttcagtatatgaaggtaattgaaaatgaaacttgatgaagggtgagatgggagagggagtgggagaggggagggtcatgggagggaaggatgttggtgggggaagccacaacaatacaaaagttgcactttgtaaattcacatttattaaataaaaaaaaagatactggcacaggcaaagagttcttggaaaagacctcagagacacaggaagtcaaagccaaaattaataaatgggattatatcaaattgagaagtctccgtgtggcaaaaaacactcaggaaagggaaaaggcatttgacagaatatgcaaaattatttgcaagctatgcaactaataaggattaataaccagaatctgtaaaaaattaagaaattcaaaaaacaaaacaaaacaacccagttaagagatgagctaagactcagacatttttccaaagaggtaatccaaattgccaacagacacatgaaaaaatattcaggatcactagctgtcagggaaatgcaaatcaaaaccacaaggaggtttcacttcaccccagatagaatggcttcatacagaaatcaacaaacatcaaatgctggtgaggatgaggggaaaaaagtaccctaatccactgttggtgggaatgtgaactggtaaagccactatggaagacactatagagatatctcaacaatctgaatatagaccaaccatacgacccaggaatacaactcctgggaatttacccaagggaaatgaattcactacacacaagagatacctgtacctccatgttatagagagtgtgggatatgtatgctatcgaatactacacagtgttaaaaaaaaaaaaaaaggaatccggtcatttgcaacataatggatgattctggaaaagatcatactaagtgaaataagccagtcccaaaggaacaaataccacatgttcttcctggtaggtgagaactaatagagcacccaaaaggaaatctagagaagtgaaattgacacttcaagaagggatgacttgagctgcccttgtcttgactgttgaggaacagttttttgtttatttggttttttctttcctactatttgttgaactccttacttaaaatagagctaatcgtatatgtataaagtcaattgaaaagagatctcagtaaaaaataagaataggaataagagagggagggagccggcgccatggctcaataggctaatcctccgcctagcggcaccggcacaccgggttctagtcccggtaggggtgccagattctgtcccagttgcccctcttccaggccagctctctgctgtggcccgggagtgcagtggaggatggcccaagtgcttgggccctgcaccccatgggagaccaggagaagcacctggctcctgccttctgatcagcgcgatgtgccggccgcagcacgttggccgcggcggccattggagggtgaaacaacggcaaaggaagacctttctctctgtttctctctctctctcactgtccactctgcatgtcaaaaaaaaaaggaataagagagggaggaagaagtttgtaactgaaaagctgtatagttctcaatattttcctacagacttacttctgagggtacagttttaaaacttgtcacgggactccaagtcccattaagcttagtggtaaaaatgccattgtaattgttaaagtgatcatattgagtgttaaggtgaatatataggtaggattaagttttaaagtgatcatataaataggatcaagtgcctggtaataataagagatagaattaaaaaggagagaatgttccaacgtgagcagaagtccacacagcagactcataggatgacaatcgctttaagtaacactctgacctcagatgcaccacctaagtcttcctggtctgactgaaaagcccatgagaacatttcagccaagacactgtggcaaaaatattctacatgaaggttctctgtgagtgagacctgtggggaaagaagcggccatcaaagaaggaggtacttttctctcaagggaggagagaacttccactttgcttatggccttgtttaaatactgaaagagattgtagattcaaaaggcttccatagcctaagcagctcatatcaagagcctcgggtggtcgctgatgtcatacataaaagtgttaattgttaaattaacaacaggggcactgtgcactaactccctatgcatgacctctgtcctcagtgagttgtattatgagagttaactgtaaaaccagttctctctctgtgtgtgtgtgtgtgtgtattgttgaaatcttcacttagtatagagttggcttctgtttacaaactaattgaaaatgaatcttaatggagcatgggactggcaaggggagaggtaagaggaagaggggtggaatgtagatgggagggcgggtatggtgggagaaaatgtattccaaaagttgtacttatgaaatttgtattccttaaaaatttttcaaatattaaaaattaaaaaaataatattgttatgtggacatcattcacccgaatcctaaatttcctccatggtttttgaagtgtttttgatgctacaaatgtaattttttagaaaagattcttttatttattgaaagtcagagttacagagagagagaagagacccagagaaagagttcttccacctgctggttcactccccagacgacagtgacaccaggagccaggagtttcttcagggtctcccacttggacacagaggcccaagcactatgaccatgcttttctgctttcccaggtgcatcagcaagagacagaatgaaagacgaacacacagcagtatgggatgcaggcaacacaggtggaggattcacctgctacaccacagtgacgttttctgcattttctgcacttttgttctcaatgtacaatgtaccactgattttcacaaatggcatgaggtagtggagtatatttttatccatcatttcctgcacgtgctgtcagccctgtgttggcagtttgtttctgatagcactttcccccagtcacacatgcactgtgcagactcatccccttgcccagatgcagtgggaggtgaatcgctggttccttcagaaaatttgggtttgctgtaaccgtttcctaagttccaattctcaatggatgattctgtccctaacaccgatcaccgagcagaagttttggtatcacgggaagacgtcacatgaagaaaatggggtcgtttctggaggaatgaatgacatctctggggtcctcagcatctgagacctgactaagctctgggcacccggggaggcttttcggggtctgagtctctggagtgtgccccgtggtattctctgatgacgtcatctgggagcccgctgagagcccaggggcagtgtagagccggtcaggggctatggatgctgcagtgtttcacatccatgccctcccctcctgcacagctgggccctgaggggtgagctgaccccgtggtcctggtccctggggctccgtgtccattctctgcagctgtgccctcgtctcccttcacttcttcaccctgaactcacaggttgaggtccacgtgctccaatccccaggtcagggattaacctgcagctcaggggtggctcaggctgtggctcctagaaaccctgcttgctcttcctcactcacgtctcctgggatccccggacctgcactcatttgcaagcagaggtggccgttggtagtgcaaggggtcagactcatggaaaacactgggtgtggagaggtcttgttccccccactctgctggccttgtctccatctcagggagaccagcaggtgggacagcccagtgaagtctgcactagaatccaggtggttctggactgtgtccctgtgagcccaccaatgatccaaccctggagctgcatccctgctgcatgaagggcctgccccagagactgtgtgtccagagaccccgactccttcctccagggactgcccgcacctgttctcagccgtgctcctccttctgtggaagcaaaattgtccttgctttctctcaactctgtcgtcatcaggaatgaacaaattgtctgctcttcaccaggataactgtatcaaccccatgtgtttacaaaatgtctcctgcaaaaatgcaattgttctctcgtgtaggattcttacagaacctgaagcaattcactcagctgatgtagaaatgactatttctgagtggctctgtctaaatctggagacacacatgtgagtctctgtttcaggtgggaacagaggagtggctagtgtggggctcttctatcatgttccgtttcttggttctataacacagaagccatgcaggaggagcgacatgattcctgataagaagagggcttccatctgtctctctgcctctctctctctctcactgtctgtaattataaaatataataaattataaaatataagaaaagaagagggcaacctcccagagatcagttcatgggggttccattcaccactacttccagagcttggccacgaagttcatggtacatccatgaaaactccctggggaaacccatctgctatcgggagatttttgtagcaaagtgaatagaacagacacagacgagggaaatctcttccttggacatgagatgatggaataaagggtcaattaaatgaaggagtcatcattacacatggaggtgatagagcgtgatggagcaagagagagtgagcttccatccactggtttgccacccaaaatgcctgcaacagtagggactcagccaggcaaaacccaagcctagaagtcaatcgaggtctcacatatgggcagcaggaaaccaactacttgagacatccaactgcatcccagagtggacattaacaggaagctggactcacaggcaaagccacaacgcaaacctgagcaccgggatatgggaactggtgtcataatgctgcgtccatcatctgcatcatcacgcactgttttgtaaaatgagtttgtgtgttcccctgtgaacccctcattgcagtccttgcactttgggatacaggctattgatcatacattcgattggaaacagttacttccgatctgtgtgtggtctgttcacttttcagttattcctttacaattcagaagcattatagtttatgcagcatcatgttaaaatattttcttatattttctgcaccttcgggatctaaaacagaaatcatcgccacaccagtatcaagaagactttgctcttttagtagttttacactggactttacatctgatgtccgatcatggtctaattccatgctgtttatgtaaacacccaattcccccaacacaatttaatgaaaagataccttttcattgtgcttggtaccattgcctaaaattagctatgtgaggactagtgcatctatttctagaatgtcagttgtgctccttttgtgtgttattttaatcacagtaccatgctgttctagttattattgctgctccctaactttttttttgagaggcagagttaggcagagagagagagaggaaggtcttccttctgttggttcacccccacaaatggctgctatggctggtgccgcaccaatccgaagccaggagccaggtgcttcttcctggtctcccatgcgggtgcagggcccaaggacctgggccatcctccactgccttcccgggccacagcagagagctggactggaagaggagcaactgggacagaatccggcgccccaaccgggactagaacccggggtgctggcgccacaggtggcggattagcctagtgaaccacggtgcaggcctgctccctaacttttgatgaggtctgttgttatctccaactttgttattatcctcggaattcctttggtcatcctgagccctttctctttctgcgtggattttagcattgttttcttgctatttctgtgcagaatgtcctgtgattttcatggaatgtgcatagagtctgtcaaagtctttggggcagtgtggatatttgaacaatgtcaagtctttaaacgcatggacatggctgcctctccacttttgtgtgctttctcccataatcagctgtagaatgctcgctgcaacatccttcactgcctggttgaatttactggcggatacttcatgttcttggagctcttgtgaatgtgactgaactactgaccattttcaaagcttgttattcgtgagttaagaggtctgtgcgtggatttggcaccaagccatgcgctgaatacttgtcatttatagcagattctggatggaatttgtacatggtcctgtatttgacgtcacaccatgtgcaagcagggataatctgattcctcctttcttacttggtactctttattctttgtctcatctagatgctgtgactgagacatcgggatgatcatgaacatgagtggggaaggtggacgtccctgtcttggtccacatcttagtggacaggcatttagcttgctccattcagtcaggtgctgtctttggggttgtcacgtgtcatccttgcagctcagtttgctgaaatgttcatcatgaggagatgtggaattgtgttgagtgccttctgcattattgagatgaccacacgctttctctcccccattctggtgatgtgacattttatatttactgactcgtccctggtgaatccactttgcacctcagggataaatcccccgtgatcatggtgaatcttggatgtgccgaatgactacactgcaagtatttatgacgactcttcagtttctaaccttcttgctctacatacagatgacgcgtctttggcccccaaaacgcaggcagtaggagaaccagcaggcacctgaacaccttcgccctggtgcagctccttcctgggaatcagcacctcagatgagacacagcgccacgaggggctgccaggggagctctggcccggttccaggagcaccagagcccaagcaggaacagcatgaccaatccctctgccagcaccatggcccagctcagggacatgtgtccgaggagccggcttagagggagtatctgcagagagccagatctgaaccatctgttgtggcctcctctgccaggggacagtgacaaggacaaagggcctccctaggcttccagcagctgagggagttgggtaatggaagcagggcatggcaggggtgggcattatgtcatctgagctccagggggctggggtcaaatggcacactggggagtgttcatctggaggcgaaaaggcacagggaagcagggctgggcctccacctgacctgttccgtctcctctctggctttttgaatacaaggaatgtatttaccacattgcaggcaccagtctgaagaaggaggaggcctaggagctccccgatctctcagcgaccattggaacccccacagaagccctgcaacagctggcagtggggagccgcagtcacaagaaaatgcaacaacagctgcagaaactgctgcatctttctctctcatgagatgtgtcacgtgtgtcacacgtgtgtggacatgtatgccgtgtctctgtggctaagtaaataagctggtgattctactgggtgaactgaagtacagcaactttaaatgtgttaacatgttatagtgccagggcctgctgacctagcaggactgtaattgtcaggggctggcgctgtggtgcagccagtaaagccacgctgcctgcagtgccagcatcccgtatgggcaccagttccagtcccagctgctccacttctgatccaactccctgctaatgtgtctgggaaagcaacagaagatggcccaagtgcttgggcctttgcacccatgtgggagacccggaagaagcttctgggttcagactggcccagctctggtcattgtggccatttggggagtgaatcagatctctctctctctctctcgctcgctctctctctctctctcgctgtgtgtgtgtgtgtccctctctataactctgcctttaaaataaataaatctttaaaaattgtctcttggatggttagcctcataaaagcacagatttggcctgagatcaggcagctgttctgtgcaccacgcatgacaactttctgacttttcagtggtgactgtgcctggccaccagctcagttctcaagggtaacccaagccagagtcaaacacatgaaggtgaatgctagcaaacattttaatgcttttgatatctttcttgggttttccgagaatcaacctttcaaattaattcctttgactttgggatttgcaactggatctgtggaaatcctcaggaaatgtagctctcatctggcagagataacataatttggcttacttggattgcaaggttctctcaaagtgtgaatcgtaggcggcagctacacttacatggttgttattgacgtcgtccgtcacgattgttttcttggtagaaaaagggactctggaagcagagggcctgcccatcgcaggcccagagccacaaggatggggggttcacagagcctctgcgcctttagggtgctgtgtgccatgagagcagtaagtctcctcgctaacggctgacatccaaattttaatcacaatgatgtgaacacttttctcagccgcagctttgattctcctctagaaaccatcaatggcatccgggtttgaatcgtgatggttctaaggcttctgtcacccatggctctgattcttctctagaaacaaccaaagaagagtccagcaaatgtttgtaaatgcaggtttctaatttaaaaatcagtgttgaagaattctgatatggaaactgataatggagctcaaataaaactagaaatataattacctaagactcaagaaagtgatcaagtttgtgggcctctatgtcttttacttaagaaattggtggctctatattcaaatgcatcatcttctgggctgaaatattttctgagatttgcagggtttgcatcactttggtagtataatactcctgctgttaggttgcagcacttttcattgttttcaagatacaagccgggtttgtcatgctcatgttccacagaagtacagttcccaacaagacagcgctggcctggcatgctgagaactgataaacttcattttaacaatggactccggataagcataacctgaggactcctcctctttattggttaaaatgtggataaaagtagtttttgatactgactgttcaagctgtcaatcagttgccacccaacatgggaccaaatcagaccaacaaccacgaccaaggccatcctggcaaaagggacaaacagaacccagctacaagtgactgattagcaatgatttttccataaaagaggtcacaagaggaaaatatataagttaagaggggctggcaccgtggctcacttggttaatcctctgcctgcagcactgacatcccatatgggcgctgggctctagtcccggttgctcctcttccagtccagctctctgctgtggcccaggagggcaatggaggatggcccaggtgcttgggtcctgcacccacatgggagaccaggaagaagcacctggctcctggctttggatcagcacagcgtcggctgtagcagccatttgggggggggggtgagccaacagaatgaagacctttctctctgtctctctctcactgtctatatctctctacctgtcaatatatatatatatatatatatatatataagttaagatggaatcactggttccaagcctacatttaaatacataaagttgagaggttataaaatgttagcctgtgccacggctcagtaggctaatcctccaccttgcggcgctggcacaccgggttctagtcctggtcggggcaccggattctgtcctggttgcccctcttccaggccagctctctgctgtggccagggagtgcagtggaggatggcccaagtacttgggccctgcaccccatgggagaccaggagaagcacctggctcctgccattggataggcacagtgcgccggccgtggcggccattggagggtgaaccaacagcaaaagaagacctttctctctgtctctcactctcactgtccactctgcctgtcaaaaaaaaagtgttcttatgcatggttgtctgatagcaactgtcacaaaattctgccaaggctgcagcctctacagagagccaccactgagttagagaaacgtactaactagatgtgactgtggtatctaacagaacaggatgaggtgcgtgtgttggcctatgcttcctgctctgctcaggttaactctctgtcccaaagataaatattaataaaacctgggtagccatctggctcctacagactctagatcgcaaatgccctcttccaaggagcttgaaaggttttcaagttattcttctggatggtgtctaatagcaggcccggtttcacaggaattttaatgtcaggatgaacactcctagtgatagttttttgtcattttatttagggcttgaaagtcattttgtggccagcgccacggctcactaggctaatcctccacctgcagcgccggcatcccgggttctagtcctggttggggcgccagattctgtcctggttgctcctcttccagtccagctctcagctgtggcccggaaaggcagtgggggatggcccacctgggccctgcacccgcatgggagaccaggagaaagcgcctggctcctggcttcagattggcgcagcacctgccgcagctgccacttggggggtgaaccaatggaaggaagacctttctctctgtctgtctctctctctctcactatctaactctgcctgttaaaaaaaaaaaagtcattttgttatacctataaataccttgtaagtagaagtaaacaaatgcctttggcccactctctctcttagaggatagacctgaaaacgatgtatttcactatgtccaagctttcgattcctaaaccctctcctcaccaccctcctccaatggggaaggcatgacaggaggaagacaacctgactgtgacccaggaactgggtaggtttctcccttcaaaaccaggaaaggagccagcttgtctgggcactggtagatagggcagggcagtttccctcagggcaatatcccacaggacgtttaattatgggcaggcagccagcagggtattactggacctatagtctttttccatctctgatctgttaaattgaagaagttcaaatccaaaacacagcggagacactcagacaatgactgagttgcttaccgctgtctttgcaactcatcaccccattgggcagatacccagacttgccaaatattctgcctgcacgcatagcctggcgacaaagcagataagagacacaacacctccgtcaggctctcaaccccataactgtcatgccatggcgaccctaatgtggacagcgtgatgtgagaatgagtagctataggatgtgtgttctggctgggtgtggaaaggggtatattggccaatggcatgatggttgggctatcttcctagacaatccaaatgtgaagttcaagactgtgtccactccaagtcctgccactctgctgcctacccaggaaaatgagctccctcatcatgaccatctggagaccttggagactggtttctccgtgaaatggcactgccagaccaccccgccctgagccagacctgacccttttcactgaccgcagcagtttcatggggaatggacctggagcccaggtatgcggtggtcacaggacgacaagtactggaagccatgacactaagtcaggactttggcccagaaggctggagcggtcactctaatcagagctctttggcagcagaaggaaagaagatagacatggacctgggctacaaatgtgccttcgtgactagacatactcgccatgataattgcaaggaaaggaggatcctgacaacagggtttaggacattaagtaggcagccgagatcctgactctactgcagtctgaagcagagccaaacaggtggcagcaatgcatagttctagtcaccaaaagtggcctctcgggttgcaaaaggaaaccaggccaccaatctgtctgccaaaacatcagctaaaggaaagagtattcttgggccttgacatttcaacttgacttacaccaacacaagcgtctttataccaaggaagacaaggcaagagcaaaggccaaggggtttgatgggagggatgacatcaacaggtggaaatagaagtcccatggctcctccttctagccaaggccctggtcagaccctccatgggcacttgtgtggtggacacgccgcagtgtggtgccctgatggactttgtggagtcccatccagggtgacctcatctctgcaggtagcacagcagacggtacatggttgttctctctgtgtgtttggaacagccccaagaagttgtcaactagaaggggcacccaacatgaggtgacgactacaaatagactttgctcagatgcctaggacaactggggactccaagtgtttgcttgtctcagtggacacgtttttggtgtgggtagaagttcaccccaccaggacagagagatctgggacagccgagacgtggttaaggggacttgttcctaaatgtggactcccttcttctgtacgaggcaccagtgggctcctttcacctcctaagtagctcagccagcgggtggatccctcatttacagtgagagctgcgtgtgctttgcagtcctcagtctactgcagaaaccaaaaagaggcaccacagcttgaagaagacagccgacagacgacgccaagaaactggcctgaggtgggataaggccttgcacttgtcctcctggggacaagggtagcccccacaaagtgggttccagttgagtccctatggaataggatgtgggagaatcctgatgtcccgaggtaagtatgcaaatattgctttaagtgaagacaataaaaacgtgtcccggagacaaatcagatacaataactgtacataacttctgccccacagtcagaaacgccacttcgtctttttttttcttttttcttttatttatttgacaggcagatttatagacagtgagagagagagagagagagagagagagagaaaggtcttccttccgttggttcacccccacaaatggctgctacagccgacgctgcgccgatccaaagccaggagccaggtgcttctcctgatcccccatgtgggtgcaggacccaaacacttgggccatcctccacaccctcccgggccacagcagagagctggactagaagaagagcaactaggactagaacctggcgccacaggcagaggattagccaagtgagccacagcattggccccaagtcactttgtcttttcaagcttggaagctgtggtgtcctggatgaagatcagttgctgcgaagtccatgaagctgtctgggttcaagcctcgactccatcacacgagagcccaagagggtctgagacgccctcagtggctgcgtcagcctgcgtaaaagccaaagccgcccttggagctgacatctttgcttgtctgctcatttcatctacaagatggggagacgactcgttcactcaggtcaagccgactctggcctcctcaacctgactgaccagctgctggatttgccttcccaggtgccatggatcatggtgaccccttcaggcaccaagtacaaaatttcccatggcgccatggatcgggtgatccattcatcaccgggtacaggatttcccaggtgccatggattgcagtgacccctttaggcactgggtacctttcagacctgatgtatccagtgggcataactcacctcaccactggaaaatgttctgatgtcccatgccttgccctgcccctcatccacggtcatgtgtctcagataattttcaagtgtgagctcacaggaacttccagtgtccccatactcggtgtgctccattaggcttgttcctcaagttgcctgcactgtgccctgtagcccggcgggcagggcagcacacccacaggtcctctgcaatggacctcaaacactggcactgaagtggagactgctgtagccctcacagagcagtgtttgacttccatgaggttttgtggctggcagggtctgtgccattgcctgggcttcttgctctgtgtctatcaacacctcagcccaggtggaagtccgtggagagaaagttcagcagcaggctattgggttgctgcagacccttggccaccgtgccccgttttgagatggtacagacatggaattaagcaagacacagggtcactgtggcctgggggcttcccacctacctgatcttgggaaactcgtgaagagtcatccacaacataagtaaggataaaatcagagtaacattgaatatctcacattaccagtcccagggcatgttattcacagtgaacacggcaacagaaagttaggctgtttatggaaaacagttgaatgtagacattcgtacataataataggaatctacaggcgatgatttttaaatcttcatttattttcattttatttgaaagagacataaaggcagagagagagagagaaattttatatccataattccctccccacatgctcacaacagccaagagtgagcaaaccaaaagacaggagcctagaagtcagcccagatttcccgtattggcaaggaggacccagagtttgagccaatactcattgtctcccagggtacacatcggtgaaaagcaggaacagaatcagagaggccgagactgaaccaggacgcaggtgtcccaagcagcatcctgacctctgtgtcacactactcactcccctgacccccaacttgcaggaaatgaccaggggctcccaggacccccagagggagctcaggaatcactaagcccaggcccacctcagggcaagctgtggtcactggaggagaggtctgcgtcttggcaaaagtgcagttgcttctgcttgatggataagctgccctccttgatagataagctgctttctctcttgaaaccccagatctcaggctgcaagaggactggagttgagattcttctgcctctgcagttcctgcgaagaagtcgcctagcacccctgagaaatgcttgcttcccctggagaagaagcattcattcaaacctgcaaatgccttggaggggctcagggtagggcttgggcgaagctggacacaggacaacccagctcctgctctccagaacacacaacccgcagacgcagtggctgagttgtcagcacctaagcagctgccaagagctggcgtttgaaagcagtcgggtctgagcatttgccccacactttgggattaaggttcatgaaggacagctgtggtcagtgtccttgggtgccaggaggacaatggcctgacctattctctcagcagacctgaaatttgagcagcccgtcatgtgcacggatccatccggaaaccggaagaagggacatccacatggcggggatacaaaggctgagtctctgagggaggagcctgcttgcacctgctgctcaccacttacctggctttctgctccctccatgtttctggggcggtctcaagtgggcttactccccacagtgcattgtaaaatgctccaaccatagtggaaggataatggggcttccccaaaagcaaaagtactgcagtgtcacccagcacttccatctctaggtccatactcaggatgagtgaatgcaggcaggtctttgaaaagaagcacagggaacttagtggcgtaaaaaaagataatcttttcaacagagagtattaaaacaacaacaaacaagaaaaaccattaaaacgctatgatttctacagagatcaactcaaaatggattacacacctcttgtgcaacacacatcaacacaatttctagaggaagccgtggagaaaatcctgggtgtcctttagttccctttaaggtcttagctacaaccccaacataccctttataaaggaaaaaatatgaataaatgcaacttccttattattccaagcttcagcgtgtgaatgacactgtgatggaagcggaaggaggggaaggacacatctcaagaagcacttgcgcccagagcttaggaagactagggcccacagtgtggcgtagcgggtaaagccgctgcttgcagccccagcattccataggggcgctgttcaagtcccggctgctccatttccaatccagccctctactatggcctgggaaagcagtagaagatggcccaagtgcttggcccctgcacccacgtgggagaccagaagaagctcctggctcctggctcccggctcctggcttcagttggcccagctccagctgttgcagccaaatggggagtgaaccagcggatggaagacctctttctctgcatctcctctctgtgtgtagctctgactttcaaataaataaataaatctttaaaaaaaaataactaaagtcagcactaagcaataagcagcccaagagaaaactacagaaagcaggagaacgacacttgcaagaagatctctgtgaaatcctgcgtctccctttcccctggccaacccaccccacccaccaaagagaagagcaaagaaaaccaagatccatctctttgctgccaggaaaaacatccacttctggacagggaaagggagagataagaaagcacaggcgtggtctcaagctgaggtcctcatgcctgaagagataggaccacccctgagaccagcacccttcccagccctcccaagacagtaaaagagagaccaccagggaggccactgcaggaaagcccaagcccaaaccacgagatggccctcaccatggccagggacagcaccgtgggcagctttgcttcgtgcgcatccacagggaaggctctcctcccgtttcgtgcagctagaattgagatgcatgaatacctttgcctggcgcctcagcagggacagggtttggcaatgagtgaccacagggtcaggagatctcactgaggataccctggacccccgggctcccagccaaaagagatggatgggcagttggagacccagggagactcaaagtgctggatctgggttggctgaccttgtccccaggctccgagcagcatctgttccacgcccgcggtaagtggcctctgctccaggccagacttgtgtgtgtgagtgcatggccacggtgtcctctctctgctagaacaggagaaattcctcccgcagaggggaaacaagatggagacatgcaaacagggtcaaagtcacctgcctccgcccgtgtcaggggctccctcgtgggcctggtgggtagcttgcagctctatggaggggcctccctactgtgcagactgtaaggagggccacgtcccagtgccactgacaaaacagcagagccaggagcagccaccaggtgtggccaaggcccaggacacatccagagccctgaggactcaaggacagcagcccccagtgctcactgctgcgtgtggatccagggaaacaaaggaaacctccaactgcctctcggcctgctctggcccctgcatggacctggggagctgcgagacccagcccaggggagagcccacaggtgcactgctcagtgggggtgagacagacgagtcctgtgtggagattcatgacagccagggtggcgtgtggcatgtgcaatggcctgccctgtgctacaggcctaactcccccaacctcagggggaagggtgagccttggaactgcacagtgccacacagagcccagggggcagccctctggggtcaggaccatccctgacagagggcgagaggttgaggggcttgaggcaagccttcccctgagccccacccaggggcagactcaggtggctgggactgcatcagcctagcctcccactgcccccaggccgagtgggctatgatgccctccatggggtacaggtgctcccagtgcacgggaagcagagggaacaggatccagctgggatctggtgtggcagaagagggcctggctccaccagcttgtccagggcaatagggctgaggggcccccatagggtctgggtccttgtcctaggacctgagacagcgccctcccagggagaaggcgtctttgcgtggagagatggagaaccaacatgaggaagtaaagtagtctcagcgtccctctggatgggaccatgagagacagcatggacagaggccccgtggaggccgggagaggacgtggacagtgcaggcaactctccagggcctacctgcaacagctgggccttggccctgtgggattctctgacatccagagccctctgtgcccatggtgaggacagccacggcacaccgtgcaggccccgggaaatgtcactcagagccagcacctgaccccatacaactggcaaaatcttacccacacccagaccacccaacccacatccacaccaccaccacccacacccatgccaccctcactctcacacccaactcagctctcggcagcatctgacctcttgtcccatggtcagacacccgctagggtcagactccccttctacatcccctgagctgggggctttgtttccgtcaggcactgacctccttggggcagtaccactcctgagggggaccctaggagttggggagttggctctggtctctccaaggtgctgctggctcccctcacagccttgggtcccacgcccatggctcaactgctgggtggtccttccctgtgctctgaccactcacacctgccatggctgacacgtgccctgggcacatactcactggctccaaaacctgaaaaggaagccagcccctgcacgactctggaaaatgtgagctgtgactccatccagtgacagccacagagcaggagctggggtcctgctcctgtccccggcttggaggggccaacaacaggacctgggcagctgatggacagagggcttttaccttgggatgtaggtgtggaggcccggagaccccaccaagagcctcagggaagtgtccaccctactggagagaggagagtctccgtgctgtatcttgtccctggacaaagagtgtgttccgggctggtgcagggagcctgcagtgagaggggccaagacctccaggtgaggccagagtcaggagagggcagcagagcttcaacccactgaggactggaggggctgggccgggtgccagggctgggtgccagggctgtgtcactgacccacaaacagaggcctgagaggctgaagcagaactctgtgcgtctcagggctgagcccaaagacaagagccttggaccacctggagagaccgcgttgaatagcagctgaggcctgcagtcctcacccagggaaggctgagtcccttggacactgaggcccagggctcagggcaggggccctgctgggaagggtcccatttaccaggatttccactgaaagacagctcatgagcctgcctagaacagtgagtccaacacagccacacaggaacctggaaaaacgcagactgcacttgacacagaagtcaacgcctggacacagcagtgagaacacagcctcagtgtccatgcagggtggccaaggggtctgcagcagaggacctgggagccttgagcttgggatgggcaaggacatgacacagcactctctgcacccacaggtcctggtccatagaattctcagaggcagagtgtccacagggatgagcaacctgccactgcaaagaccagcacttaggagccagcacctcacagccagcacacacagcccagctgctcaggggccagcacctcacagccagcacatacagcccagctgctcaggagtcagcacctaggggctagcacctcacagccagcacaaagagactagctgttcaggagccagcactggggagccagcacctcacagccaactcacacagcccagctgctcaggggccagcaccccacagccaacacacacagcccagctgctcacagtcagctcctcacagcccagcacacacagcccagcagacacagtctggcctaatccgctgtgtctctacaattcttgagtgttgacaccctgaaaactctcacaagatttttgaagactaaagatgtaagggtccggaaagaccagattttaccacactccaggaggtgagagccctggagatgacccaagcaggggacatttgccagggtctgaatccgggtaggcatgtgcaggagggatctgcaatttcagcctccttcactctgtcttccctctctcagccatagccacagacttgtgagcaggggaagccacccatcaacctgacccggccgcaggtgctcgccacagaggccagcagggtgccctgcaggggcatggaggcctcgggagctgttcactgcccccacggccccacgccgcccgccagccccctctttgccccactctctctctctgcgaggccaaacctctcgctgctgtcagtagtccctgaaaagcctgcttctgccgcctcactgacttgcactgtgcttatctcagacaacacttggccgggagtcggggactaaagccagggaccctgtgctcaccctgtgggcggtgcaaagggttaccttgccattgtgcgagtgtcctgggtcttgtgccactaaagcaggaagccagcagcacacagaaaacacctgcgagaggcagctggatggtgagagtcagcgcccaacctggactccaacggtgcagccacaggaggccctgcaccttcctgagcctgcacaccctgctcgccaagcctactgcgggcggcacacggagcccccggctgcgctgctgttgctctgggggccgctgcagagactgggctggagtggccggcatgaaggctcaaactgtgcaggcacacatggcagtgtgcgtgagctggagcactgcgcgggccaggcagagacctgtctctctctggggctgggatgacatctccagagacatgcacatgtgtccaaggaagagaaaccgaagccggggccacagcgtccccaggcctggccgccaggggccgggccatggcaacgtcgagggctagaacacaagccacacgaggcgactggggaagtggtggagacctggatccccaccagccacccagggtcaggaagaaagcaagagaagcccaccatgcagaatgcaaacagcaagactccaagcctttccaggcctgacgtcacaggagacctcttcctacaaaaaccctgggccaccagggcggccagtgaggagggggctcctgtccggagaggggagcttctctgtcactgcccggcctcctgctggacccagacctggcccacggggctcacctggagcagacgagggatccctgcagagggctgcagctgtcttccctgagagaagccgctggagctgcagaatctccagtgaggggaaacgggggattttgtcggggtgtgtgccactgtgg

SEQ ID NO: 37 - DNA, 1461 bp, Oryctolagus cuniculus
cacagtgacacagccccggtccaaaagcccctcccacacacacgtgctctccaggctggggggcccagcatctaggaagcaaggcccattgggacccatctccatgcaaaacccattgtgcccctgcccccagagcccccacagggcacagagcaggggctgtgacggcaaagaggagcaggggctcctgcactgtgtggtgcgagcagagccaggccagctgctgcccctcgtgcacaaaggggatcccaggaaggacggctgtgggtcagaatctgcgatcttgggagggagagcccagagcagaggcaggaggcgtcctctcgcactgctgtccgcccagggccctaatgctggtgcaggcagcactaaagacagacctggagggctggtgcagaacgcggaacacagaacccgcagcagaaaagcctgctggaggacgctgacagctggctgcggccagaccgcttgggcactcagccctaccttcctccagctagaacgccccagggaacctccctggagtagggaaggtccatctgggctgactgcaccgatgcccccagtccaacgctggcagacggggagcagagcgaaggtgggtggctcttacttaaccttcctcgagtctctgcaacctacccaagccactcactgctcaaaggccccaccttgggacccagtaatggcatcagggctctacctggtccatcgacacttagtgcaagactgggcttcagggactggagctgtggaatagtaggttaagcctctgcctgcagcgctagaacaccacatgggcatcagttcaagtcccagcagctccacttctgatgcagctccctgcggatggcctaggaaagcagcagaggatgtccgaactgcaccgatgtgggagactggaagaagctcctggctcttcacttcggataggcccagctccagatgttttggccatatagggattgaaccaacagatgaaaatctctttctataattcttcctctcaaataaaaaatattcttaaaaattaaaaaaaaaaaaaatttccaaaaaatactgggcttcaacgttagcaagagcttggaaaccaagaacctcatggacagagaagctggggctgcctaagtggggaaccccaaactggaagcaaatcagacatgagcccaaggcagagcaggtgctactaagtctcacggtggcagagcaaacgtgatggcagcacaggacagtgtcacacggagtggcatggtggcttcgctttcagtgctggtcaaagaagtaaaaaacaagtccagcacagacatccacgtcgactccatccagatcagactcgctgaggatcacattcccggttggagagctgcagggaagacgcaggaacagtgagctgagctcggggctgtggttttggcagaggacaaggaggcagggattttgtgaagggccaacccaccgtgt

SEQ ID NO: 38 - DNA, 1686 bp, Oryctolagus cuniculus
cacagtggtgcacccagcacaaaaaccctcagggacctgcagcccacaggctcctcgctgacagcctgaacatctgggagcagccagtgtgcccctcagctgagctcagcccctcaccctgaggccatccctctcactgccccacacccccagggtgcccagccagaacaggccatagggtcaaggtctctatcactgtgcctatggggtcctggttcccatggctatggggttcacactcaaaaccagctgcacatacaggggctgagcccaccccctcccaccagaccctcaacagctcgaagggccagagaagaccccaatttctcaggcttagagcccaccccaccagtgtctatcctcccgtcctacacccctcacacagccagcagcccagcccccacaaacttggtgcccacaccagaggggcagccctgccctggggtggcctctgagccccaactccagaggacgtggaggacgaagaaggcctttgctgagcccctgctcatgggttccagcgatttgcacagggtggatgggtgtgggtcccagggcccagttctcactccccctgctcttccctcgtcagccctgcatggggaagcaccaggatcctcagagggggtgagcatggtgcagggctgcttggggatgtggtaggagcctccagctgtcagtgctgacgtgtaaggtgcaggacacacttcatcggctgcccctgcagtggcctgctgagtaaacaccagcggagggggcaccacgcatgacccactgcccctcctacccagcctggcctggccactggtcagacacacccaccatctggcctctcccatgtccccagtagccacagggcaggtgcagagggacacagatgtggagagcatccagggcagctgtgcaccctggaaaggggagggggtgctcagctgtggatgccccccaggtttcccatcatcatctgcaatccacagatcccaccccaatgctttgggaggacaggaaggaaggaatttttgcaggaacctctctttgtggagggctgcaggcccggctccacctctgcacaccctactcgcctgagcctgcacactctgctcaccaagcttgctgcaagaggccctcagtgaggcctccctgtggccagttgcagctgctgacccctggcagactggggactccacactgcaggaggctcctggccggaagctctgagagacagcaaagcaggtgtgggccctctggtctgggggagccggtgctcccagcctgagagcatgcataggggcagctgcctctgaagctatgaccccactcccatgggcactcccacacacagcgccaagagctcctgaggaggtcactttcccagggagtggaagcttctaagctccgggggaaaagcccagggctgaggggtccctgtctgctcgtgcctgtgtcactgcagcacagcaacagctggtcccgctcagcacacttgaggcagcatccccagtgccaggagacatctgggatctggaagcagcacccgccattgaggctctgagtgctcagatggcaggggcagcccccgtccaccagccctcctctcccaggcaacgggctccaaagcatgaagaccagagacctcagctctgcaccgggctgcaggggaatttgcgctggtctgagacaccgtgg

SEQ ID NO: 39 - DNA, 2500 bp, Oryctolagus cuniculus
acagtgcctcaggccacacataaaacttgagccgtggccacccagagcccagattggtggaccagccccacaaagaggagaccccgcccagtagcctgcccttctctgaagaggccccaatgccctaaacagattctgagattctgagtggcccggatcacagtgggtataactggaactaccactgtgggcaatactgtgtcccaagctgcctccacagccacctaggcccagcacagcccacgccctgcccggtccctgcgtatctcccacagctcagaccctctgggtgttcgcatttcctagttaggatgaggtgagtgcaggagtcttgggtcccacagttgagagggctacccttacccaccccagccagaactgacccctcaggaggtatgcctcagggagacagcagtggccaggggaagcaggcatgacccccatgacaaccacagccaactgcaggagcagacaccccaaccctggagaagtgacagattctgcccatgagcccatagtaacctggacccctccagtatctacctcaatcagggtgggagctgggaactcatggggagctggtggaacacaggactttccagaatgtcaggtcaacaaaagccaggcaccagagaacagagccctctgacaggctgcccaccagcccttagccccagctccgagcacctaggttgaggcaacaccataaggatggggccccaaagcagcagccagagcccgggcccctcaacatgggggtcctccagggcggtcctctatagagggccccatggtgtcccccaccccattacctaagccacttgcaactgccaagcctacccggacagacagagagagtctgggctggggacttcagaggcacctcagaaaccagcacaagccttcccgcccccgacccaaacccgtgcccacctgtgtgggtcactcacctcccttcctgggtgaagaggccttgcacctatgtctcagggccagcgcaaaccacagatgggggtagtggacccaagggcagccctgacctccgccctagactccctggccccagctgcccgctgtcccggagaccagggactctgcatttccagagcttcagggcagggcccagcctccagggccgccccctccgcctccccccaccccccatgccaaggtcaggaagagccagggaacagctctgcacgaaacaggcttcctgccaggggctctggttctcccagcctgcagtttctccttccttccttcggggtaacggccagagctcccctcacgcacccctcctccacccagctgcagcctcagcgtgcctggctcgggcccagcgctgtgcagagaggaagggcaggacggacacagcacaggcggctgggacccagaacgcgcgctcagacagccttctaggggtctctctcgatgcccagaattgccctggacaaggaatctaatgcccactgcaggtcctagtctcacccagagataaaattctaagtggagacatagtagcaagtccagataagaacaccattcatttattcaaagtgagatagaaaatatgggagcgaggtctggacccagtagatgagtgtggtctgccccaacctaattggagacaaaaaaaaaaaaaaaaaaaaaaaaaaaaaaaaaaaaaacacttcaggaagagcagtaggaaaaaaaaaacagaagaaaaattaaaaataagacatcacaaaaggacattggtggggtcggcgctgtgacatagctggtaaaactgagcctgcagtgccggcatcccatacgggttccagtacaagtcctggttgctccacttccggtccagctctctgctgtagcctgggaaagcagtagaagatggcccaagtccttaggcccctaccccgacatgggggacgcgacttaggatcggtgcagttccggaactagcagccaactggggagtgaaccaggggatagaagacctctctctctctcattctctctttctctgtaactctgcctttaaaatgaataaataaatttttaaaaaaaaaagtgcaggggagagaggaagaatgtgacagaattaaagagatgaaacagatactgccggccaggaggagagaagcaacaaagtgtggctccggcctgggcactggcatcccatagacaggtgccacttgcagtcctggctgctccacctctgatccagctcctgctgatgtcctgggaaagcagtgcaggacgtcccaactgcttgagccactgcatccacataggagacccagaaggatttcctggcccctgacttcagatcagcccagctctggccctaaaggccatctggggagtgaaccagtaaatggaagatttcgctctctctgtgtgtgtctctacctctctgtctgtaacaatactctcaaacaattagatcaaccatttataaaattaaaaaataaaatatttccaaaaaatactgaggttcaaacattagcaaaagctt

SEQ ID NO: 40 - DNA, 32462 bp, Oryctolagus cuniculus
gacacagtgaggggccctcaggctgagcccagacacaaacctccctgcagggtcgcgcggctctaccagggggcgctcaagacgcactgagtgcagattctggtcctgcacaggcgcagaagatgaagccctggtctcctgtgagggaattggggtttcctctcctgtagcagttttgagggaagaattctactttttgattctgtccttcccaacttcactgacggagagaaagtttgatgtaaaaggaagaagtcctaattgaacaatttggttcatggacagcgactgtgctcaccagggtcagagatgtgggaatattgaggactctattgagtctcttccaacctgactcaggacagcaccctcagggcactgaaagctttggacagtttcagttttccctgtataaccagggacagctgagacagggtcgttgatctgttaaacagcaactattccactcatccctctcctgccacaaccagcaagtgtgcactaaaccaacctttgactctacatgtgggtgatccacactcactttctgcagactttaacccgacctgcatttccctttaatcctggaacagtctgtggtccttgtgtgaacgtcacagcactcaggaatgtactgcagctcagctgtgtctcaggctgagcttctgcaggcacctgggaagcctacagggacttcctcatcctctaggtcctgggaccctcctggggggctccctgcctgaactcaggagggaaatgccctggacatcagcagtcaaggtcatcactgaatggaaagtgttgggtgtgcacttccagctgatctggttctgtcaagtgtcgtggcacctcctgcacctgctgtggttcagggagagcagaaagtgggacacagagtggctgtgcactctggggctggagtccacatcacggggagctgtgtctgtggctccagcatgatgcccagtgtcctgaggctgaatcacagctgcaggaagagccagtcccagagaccatgtgtccagagtccctgctcttcactccatgtctatgctgactggggtcatggatccattcggagtctttcatcagttttagagagggagatagatacacaggctgcatatcagagttctggacagagcacatttacactatttctatacttgtaagtgaaaatgcaccctaaagacagcagatgatggaccagttatgaagccccatgaacaaggtgcaaacgctattgcagttccatgctcccgggttccagctgccaagcctcaaattaactggcatttatttatcatctacataaaacactgagaaacacaacaccagtattgagcgaactgaatctgtagttggccattttgtcattttattttcataaatgtttgataaataataattgaacatagacatgagataaatgatatgtgttcaaaaatgactgtatcaaattgatggaattatgaagtcattcttattgacatgctcatcacaaaatccacatgttcccatggtcgaatgtcagtggtctcctgttttggaattcaatagacccaatattcatttcactgctgtgaccatgctgtacagtagatcctcagtgtgtggttcctgtgggactgaaactctgaccttgctccagcatctcctctgttcctccctcactcagactttggtcttcaccatcgtagttcctgaatctgtgagttcatccttttatcccacgtaggtagcatcacatattatgtgtcttcttgactagatggtaatctgtacatttactgacacattatccttaggcattattctcagcattatccaagttatccaagacatcagaatttcttcctctttactgccttataaacttcatgttaaaatataactctgtccatttgtcccattatccatccttcctcaaggctaatttcactggattatgtgtgtgaactcttgagaatgacgctgctttaattgaacaggggactgcagagctgtttgccatagtgactgtggatcccatggtctcctccctgggatttcatattccttcttcccaggaatggtgttggaggatcctgtgataattctatttctcagcttctgatgttttccatgaaagctttcctaatttacctgactccagcctttaccaggttatcttctctctcttcctgcacaacatgtgtcagctctggtatgtctggtgatactcagtctaacaaagggatggggtatctcattgtttctccagcatgtacgtgcatgatgatcccagatttaaagcatttttatacatttgcctttatatattatattttaaaaattacagatacactttcacctcttttaaaacttgtatttgtgtatttgtccaaaaggaaaaagagacagagactgacaacagtgatctagtgaatcctggagcacttcccagatgcccataaaagctggcatttggtaagaccatagccaggtgcatggaattcagtccaggtctcacacatgaaattaactcagacttctcatactgcctcccagagtgcgcattggcaggaatctgaaattgggatctaaactgggacataaacctaagcatcctgatgcaggaggcaggaatcccatgtgataccctcaatgctgctcctatcacccaccttgtcagtcactgcatttgaacaactgattgcttcccctgtgattcagttgcttgagttcattcaacatttggatctaggctcctaatcatatgtacaattatctttcatttattttgaatatctatgtatttgatttgaaaggcagtattatagcaagagaggaagagaccaacagagggagagagaagcttccatccactggtttccttcctgaatggctgcaaaggctgggcaagggcaagactgaagcaaggagcctggaacttcctccagtttcccacagagctcgaaggggacacacacttgagtcatcgttgacagagttctctggtccatgagcagggagctggatttgaagtgcagcaagcaagatctgaacccatgctgctgagtgatgctgcatagggatggcagcttaacctgcggggccaaatgttggacaacccatgtgtgacctgaaaatgctttctccccatctgtggttgtctttggttcttcaattactccctttgttacacagaagctctgtggttggatccattatcttttacctatttttgctaggttgcctgtacattggagattatcaaaataccattgcccaaaccaatgtcagcttgcttttgtccagtgttttcttctagatctttactgtctcaggtcttgccttgaaggcattcctcaagttcactctgtttctgtatgtggcgtgagatgaccacataaatgaattattttcaggtgcattcaagtgtccccaaccccaggtaacgacaggaaactcatccccatcctgtacttttgtcaccatgtttgcattcagttttctgagaatgtgtccttcatttttaggtttctattctgtcccagggctctgggtgtctattgttatcccagcaccagacttgatttcagctcagatatgatgaagcctcctgctttgccatcacaaaccctgattttcttcatgtgagatctagaattttcttccttttcctagaaataatgtcaggctatttcacaggaaatgcattgaatctgtgaatcatgttgtagcttggctattttaacaagctcatatcttcaaatccatgactacgtcattccaatttacagggaatcatcaaattccttttcactttttaaattattatgtattgcagaagtatgagtgaagacccctatcttacaccttacacaaaactccactcaacatggattaaaaatataaatctatgaccctacaccatccagttattagagaacatttgtgaaaccctgcaagatactggcacaggggggttcgggaagatggcggaatagggagggagcacaccgatggtctgggaagggaaggttcaaagagggttgagaatttgtagtttcggggaaagggaagctcttccaaaactggggagacagggtggacctgcgaggaggatgtggatgtctgaagcgcaggacaccagcaggagtgtgtacgcaccagcgctggaagccgaggtgagacagggcgctcgcccagcaccactgcaacagccgctgccgcccctcccccaacccactctgggacggacactgagacatgcacgactgagtgggggaggaaatagaaaacggaacagagtgagtagcgcctgcggaaagagtgcgcgattcagggggactaattgagggactaaacaagctaggatcccttggtgcctccaccctcccccaaataggagctgcatcgggcaggaagcagccatcttgtttgtttacattcgggcttaaaggagaactgcctctgcctctgcattaacctttggaggcggagcccaaaggtggagtggagtgacaggacactccttgcgcaggggcgggcagcaagggagggcagctcaaagccctgacaccagtctattcaagttaccagaaaaaaaaaaactgaataacacccgcgggaacagggcagcatccagggggatgaactgagggatcaaaaacgccaggatccttaggagaagcccaacccacaatcagagctgcagtgggcagagagcagccatcttgtttgtttacattcggtttaaaggaggctggcctctgctctgaaggaggaagcagcaggggcggagtccaaaggtggtctggagctacttgacactcctcatgcaggaggtgcagtgagagagagtggctgaccaaggatccccaggcacagacacataagggcgaacataggaacaaggaaaccggcccccaaggggcggagattagcacctcaaagccctgacaccagcccactcaagttataaaaaataaataaataagtaaaaaataaacaaacaaactctagaaggcagagcagcctgcttatactggatattggtacagactcacagcagcccatagcagagggaaatcaacctgaaaaaccacccagacggaatgccaaaaaaacaaaacaaaaacccacaataagaatatagaagaacatataaactcaccaatggagcaggctaaaccaaccataacagaggctgaagaagaataatttgaaactatgacagaaaaagaattcagaaaattaataatcagaatacttagaaataatgagaaacagtgtcgagagctgaacaaaaaacaagcccaaggattagagatcctaaagagaagccagaatgaaatactggaaatgaaaaactcaattgaccatataaaaaacactgtggaatccctcagaaatcgaacagatgaaatagaagaccgaatatcagaattcaaagacaaacttccagaaataatacagtcagttcaaacacaggaagaagaaattaaaaaatatggtcggagacctacaagattcaatcaaacggtgtaatgttcagataataggagtccctgagggggtggaaagagagattggattggaaggtgttttcaatgaaataatatcagaaaacttcaaacaaaggcagctggataacaacaggcaaattcaacatatagccaggactctgaacagggtagaccagaagagaaattcaccgcgacacattgtggcaacactcagctcagtgacatacaaagaacaaatcctaaaatgtgccagagaaaaatgacaaatcacattcaggggtaagttaatcagactcaccccagacttctcatcgcaaacactacaggcaaggagacaatggcatgatatatttcaagttttaaaagacaaacagtgctaacctagaatactataccctgcaaagctatcatttatgaatgaaggggaaataaagatcttccaagaaaaacagaaactgaaagaatttgtatccatgcgtgcaaccctacaacacttgctcaaagacacgctgcacacagaaatacaaaaacaagaacttcactacaaaaaaagcgaatgtagagtaacctacaaacaaagttcaaaatacataaacagctcatttcaggaaacacgaatgggaaaagacagtacttaacagtaatcacactgtatgtgaatggtcttaattctactaccaaaagacatagactagctgattggatcaagaaagagaatccatctatatgctgccttcaggagacacaccttatcagcaaagatgcacacagactgaaagtgaaaggatggaaaaagttactccaagctaacagaaatcaaaaaagagctggtgtgaccatcctaatatcagacaaaatagactttaacataaaaactattaaaagagacagagaagggcactatataatgattaaaggatctatccaacaggaagacattactattataaatgtatacacacctaattacagggcacctggctacctgaaagaattactaaaggatttaaagggagatataaattcgaatacaatagtaacaggggacttcaacaccccactctcaccaatggacagatcaaccagacagaaattcaacaaggaaacaacagagctaattgacgctatagaccaaatagacctaatagatatcttcagaaccttccaccccaaagacacagagttcacatatttctccccagtacatggaacattctctaggattgaccatatggtaggccataaagggagcctcaacaaattcaaaaaaattgaaactataccatgcagcttctcagaccatagcacagtgaaactcgaaatcaacaacccaagaatctctacatcatatgcaaatatatggagaatggacaacatgatcctaaatgaacagtgggtcatcgaagaaattaaaagagaaatcaaaagatttctagaaacaaatgaaaatgataacacaacatatcaaaacctgtgggacacagcaaaagcagtgctaagaggaaagtttatagcaactggtgcctatatcaagaagctggaaagaaccaaacaaataaactctccatgtacctcaaggatttagaaaaacagcagaaaatcaagcccaaatccagaaggaggaaagaaatactaaagatcagaaaagaaataaacagaattgaaacaaaaaaaaaaaaacaatacaaaagatcaacaaaaccaggagctggttctttgaaaaaataaacaaaattgacataccattggcccaactaaccaaaaaaaggagagagaagacccaaatctgtaaaatcatgataataatggaaatgtaacaacagacacaacagaaataaaaagaatcatcagaaaccactacaaagagatgtatgctaacaaattggggaacctggaagaaatggatagattcctggacacatacaaccttcctaaactgagccgtgaagatatagaaaatctaaacagacccataaccatggaagaaattgaatcagtaataaatgcaagagcgaaaaagaatagcccaggaccggatggcttcaccgccgaattttaccagacatttagagaacaactaaccccagttcttctcaaattattcaaaatgattgaaagggagggaatcctcccaaattctttctacgaagccaatatcaccttaattcctaagcccggaaaagacacaacagagaaagaaaactacagacctatctccctgatgaacatagatgcaaaaatactcaacaaaattctggcaaaccaaatccaactgcacatcagaaagatcattcacccggaccaagtgggatttattcctggtatgcagggatggttcaatatttgaaagtcaatccatgtaataaatcacattaataaattgagaaacaaaaatcatatgattatctcaatagatgcagagaaagcatttgacaaaatacaacaccatttcatgatgaaaaccctaagcaaattggggttagaaggaacattactcaacacaattaaggcagtctatgttaaaccaatggccaacatcatattgaatggggaaaagttggaggcatttccattgaaaactggaaccagacagggatgcccactctcaccattgctattcaatatagtcctagaagtgttagccagggccatcaggcaagaaaaagaaattaaagggatataaatgggaaaggaggaagttaaactatccctatttgcagatgacatgctactatatataggggacctgataaactcctataagagactactggaactcatagaagagtttggtaaagtagcaggatacaaagtcaatgctcagaaatcaacagcctttgtatacacagataatgccagggccgagaaagaacttctgagatcaatcccattcacaatagccacaaaaacaataaagtaccttggaataaatttaaccaaggatgtcaaagacctctatgatgaaaattacaaaacactaaagaaagaaatagaagacgacacaaaaaaatggaaaagcctggcatgctcatggattggaagaatcaatatcatcaaaatgtccattctcccaaaagcaatttacaagttcaattcaataccaatcaaaataccaaagtcattcttcaaagacctagaaaaaaatgatgttgaaatttatatggagaaacaggagacccagaatagctaaagcaatcctttacaataaaaacaaggccagaggcatcacaattccagacttcaagacatactacagggcagttataatcaaaacagcctggtactggtacagaaacagatggatagaccaatggaacagaatagaaaaaacaccggagaacaatccaaacatctataacaaactcatattcgacaaaggacctaaaaccaacccctggaacaaggacagcctcttcaacaaatggtgctgggaaaactgatgtccacatgttgaagtatgaagcaagacccctaccttacaccttatacaaaaatccactcaacatggatcaaagaactagagttgcgccacgacaccatgaaactaattgagagcataggggaaacccttcaagatatcggaataggcgaagaattcctggagaagaccccagaggcatgggtaatcaaagataaaataaacaaatgggattacctcaaattgaaaagtttctttacagcaaaggaaacagtcgggaaagtgaagaagcaaccaacagaatgggagatgttattcacaaactacacaaaagataaaggattaacaactagaatctataaaatgatcaaaaaacaccacagaatcaaaacaaacaacctaataaaaaaatgggccaaggaccttaacagacatttttcaaaagaggaaatccaaatggccaacaaacacatgaaaaaatgctcaggatccctagccatcagggaaatgcagatcaaaaccacaatgaggtttcacctcactctggttagattggcttatatacagaaatcaaccaacaacagatgctggcgaggatgtggggaaaagggacactaatccactgttggtgggaatgcaaactggtaaagccactgtggaagacagtttggaggttcctcagaaacctgaatatagcacttccacaggacccagccatcccactccttggaatttacccaaatggaattgaaggggagaaaaaaagagccatttgcacctcaatttgttgcagctcaactcacaatagctaagacatggaatcaacctaaatgtccatcaacagatgactggataaagaaactatgggatatgtactctatggaacactatacagcagtaaaaaacagtgaaatccgggcatttacaacaaaatggaagaatctggaaaacatcatgctgagtgaaataagccagtcccaaagggacaaatatcatatgttctccctgattgatggcaactaaacgagcatctaaaatgatacccattgaagtgaaatggacactatgagagacaatgacatgatcagcccttgtctagactgttgaggaacaacttactattttattccttttagtatttttgttgttgttgttgttgttgctatgtttattctacgtaagaccactggttgaactctgtaatcaatgcacaatcattcttaggtgtttaaaattaacagaaaagtgatctctgttaaacataggagtgggaataagagagggaggagatatataggttggcacatgctcactcggacttacctccaatggtggaactagaaatgtgccaggggatttcaactcaatcttaccaaggaggcaggtaccaatgccaatgcacttgataaagtgataagtataaatacacaactgatcaaaaagatagggtatgtgtcgaagagatttcacaaataagaccagtgtaagcaaataatgaaggatagaattaaaagggagagaatgatcctgcgggggaagcaggacacacagcagactcatagaatggcaaatgctcaaaacagcactcctgcctcagaatcaacccttgggacattcggatctgactaaaaggtccacgagagtctcacaggcatggaaagcccatgacacggtgacaaaaagaaacctaaatgaaagatccggatgaacaagaccccagcagaaggaacaggccatcaaggagagaggcgcctttctctgaagggaggaaggaacctctactgtgatactgccttgactaaacaagttcagagttggtgaactcaaggggcttccatagcctagacagctcatagcaagagtctcaggtgattgctgacgtcataaataagagtgccaattgttaaatcaacaacaggagtcactgggtacatgctccccacgtagaatttctgtccttaatgtgttttactatgaaacttaaaaacaacactactagtcgaacaataccctataccttgtgtggttgtgtgagtgcagcctgttgaaatccttgcttagtatgtactaagttgatcttcagtatatgaaggtaattgaaaatgaaacttgatgaagggtgagatgggagagggagtgggagaggggagggtcatgggagggaaggatgttggtgggggaagccacaacaatacaaaagttgcactttgtaaattcacatttattaaataaaaaaaaagatactggcacaggcaaagagttcttggaaaagacctcagagacacaggaagtcaaagccaaaattaataaatgggattatatcaaattgagaagtctccgtgtggcaaaaaacactcaggaaagggaaaaggcatttgacagaatatgcaaaattatttgcaagctatgcaactaataaggattaataaccagaatctgtaaaaaattaagaaattcaaaaaacaaaacaaaacaacccagttaagagatgagctaagactcagacatttttccaaagaggtaatccaaattgccaacagacacatgaaaaaatattcaggatcactagctgtcagggaaatgcaaatcaaaaccacaaggaggtttcacttcaccccagatagaatggcttcatacagaaatcaacaaacatcaaatgctggtgaggatgaggggaaaaaagtaccctaatccactgttggtgggaatgtgaactggtaaagccactatggaagacactatagagatatctcaacaatctgaatatagaccaaccatacgacccaggaatacaactcctgggaatttacccaagggaaatgaattcactacacacaagagatacctgtacctccatgttatagagagtgtgggatatgtatgctatcgaatactacacagtgttaaaaaaaaaaaaaaaggaatccggtcatttgcaacataatggatgattctggaaaagatcatactaagtgaaataagccagtcccaaaggaacaaataccacatgttcttcctggtaggtgagaactaatagagcacccaaaaggaaatctagagaagtgaaattgacacttcaagaagggatgacttgagctgcccttgtcttgactgttgaggaacagttttttgtttatttggttttttctttcctactatttgttgaactccttacttaaaatagagctaatcgtatatgtataaagtcaattgaaaagagatctcagtaaaaaataagaataggaataagagaggggagggagccggcgccatggctcaataggctaatcctccgcctagcggcaccggcacaccgggttctagtcccggtaggggtgccagattctgtcccagttgcccctcttccaggccagctctctgctgtggcccgggagtgcagtggaggatggcccaagtgcttgggccctgcaccccatgggagaccaggagaagcacctggctcctgccttctgatcagcgcgatgtgccggccgcagcacgttggccgcggcggccattggagggtgaaacaacggcaaaggaagacctttctctctgtttctctctctctctcactgtccactctgcatgtcaaaaaaaaaaggaataagagagggaggaagaagtttgtaactgaaaagctgtatagttctcaatattttcctacagacttacttctgagggtacagttttaaaacttgtcacgggactccaagtcccattaagcttagtggtaaaaatgccattgtaattgttaaagtgatcatattgagtgttaaggtgaatatataggtaggattaagttttaaagtgatcatataaataggatcaagtgcctggtaataataagagatagaattaaaaaggagagaatgttccaacgtgagcagaagtccacacagcagactcataggatgacaatcgctttaagtaacactctgacctcagatgcaccacctaagtcttcctggtctgactgaaaagcccatgagaacatttcagccaagacactgtggcaaaaatattctacatgaaggttctctgtgagtgagacctgtggggaaagaagcggccatcaaagaaggaggtacttttctctcaagggaggagagaacttccactttgcttatggccttgtttaaatactgaaagagattgtagattcaaaaggcttccatagcctaagcagctcatatcaagagcctcgggtggtcgctgatgtcatacataaaagtgttaattgttaaattaacaacaggggcactgtgcactaactccctatgcatgacctctgtcctcagtgagttgtattatgagagttaactgtaaaaccagttctctctctgtgtgtgtgtgtgtgtgtattgttgaaatcttcacttagtatagagttggcttctgtttacaaactaattgaaaatgaatcttaatggagcatgggactggcaaggggagaggtaagaggaagaggggtggaatgtagatgggagggcgggtatggtgggagaaaatgtattccaaaagttgtacttatgaaatttgtattccttaaaaatttttcaaatattaaaaattaaaaaaataatattgttatgtggacatcattcacccgaatcctaaatttcctccatggtttttgaagtgtttttgatgctacaaatgtaattttttagaaaagattcttttatttattgaaagtcagagttacagagagagagaagagacccagagaaagagttcttccacctgctggttcactccccagacgacagtgacaccaggagccaggagtttcttcagggtctcccacttggacacagaggcccaagcactatgaccatgcttttctgctttcccaggtgcatcagcaagagacagaatgaaagacgaacacacagcagtatgggatgcaggcaacacaggtggaggattcacctgctacaccacagtgacgttttctgcattttctgcacttttgttctcaatgtacaatgtaccactgattttcacaaatggcatgaggtagtggagtatatttttatccatcatttcctgcacgtgctgtcagccctgtgttggcagtttgtttctgatagcactttcccccagtcacacatgcactgtgcagactcatccccttgcccagatgcagtgggaggtgaatcgctggttccttcagaaaatttgggtttgctgtaaccgtttcctaagttccaattctcaatggatgattctgtccctaacaccgatcaccgagcagaagttttggtatcacgggaagacgtcacatgaagaaaatggggtcgtttctggaggaatgaatgacatctctggggtcctcagcatctgagacctgactaagctctgggcacccggggaggcttttcggggtctgagtctctggagtgtgccccgtggtattctctgatgacgtcatctgggagcccgctgagagcccaggggcagtgtagagccggtcaggggctatggatgctgcagtgtttcacatccatgccctcccctcctgcacagctgggccctgaggggtgagctgaccccgtggtcctggtccctggggctccgtgtccattctctgcagctgtgccctcgtctcccttcacttcttcaccctgaactcacaggttgaggtccacgtgctccaatccccaggtcagggattaacctgcagctcaggggtggctcaggctgtggctcctagaaaccctgcttgctcttcctcactcacgtctcctgggatccccggacctgcactcatttgcaagcagaggtggccgttggtagtgcaaggggtcagactcatggaaaacactgggtgtggagaggtcttgttccccccactctgctggccttgtctccatctcagggagaccagcaggtgggacagcccagtgaagtctgcactagaatccaggtggttctggactgtgtccctgtgagcccaccaatgatccaaccctggagctgcatccctgctgcatgaagggcctgccccagagactgtgtgtccagagaccccgactccttcctccagggactgcccgcacctgttctcagccgtgctcctccttctgtggaagcaaaattgtccttgctttctctcaactctgtcgtcatcaggaatgaacaaattgtctgctcttcaccaggataactgtatcaaccccatgtgtttacaaaatgtctcctgcaaaaatgcaattgttctctcgtgtaggattcttacagaacctgaagcaattcactcagctgatgtagaaatgactatttctgagtggctctgtctaaatctggagacacacatgtgagtctctgtttcaggtgggaacagaggagtggctagtgtggggctcttctatcatgttccgtttcttggttctataacacagaagccatgcaggaggagcgacatgattcctgataagaagagggcttccatctgtctctctgcctctctctctctctcactgtctgtaattataaaatataataaattataaaatataagaaaagaagagggcaacctcccagagatcagttcatgggggttccattcaccactacttccagagcttggccacgaagttcatggtacatccatgaaaactccctggggaaacccatctgctatcgggagatttttgtagcaaagtgaatagaacagacacagacgagggaaatctcttccttggacatgagatgatggaataaagggtcaattaaatgaaggagtcatcattacacatggaggtgatagagcgtgatggagcaagagagagtgagcttccatccactggtttgccacccaaaatgcctgcaacagtagggactcagccaggcaaaacccaagcctagaagtcaatcgaggtctcacatatgggcagcaggaaaccaactacttgagacatccaactgcatcccagagtggacattaacaggaagctggactcacaggcaaagccacaacgcaaacctgagcaccgggatatgggaactggtgtcataatgctgcgtccatcatctgcatcatcacgcactgttttgtaaaatgagtttgtgtgttcccctgtgaacccctcattgcagtccttgcactttgggatacaggctattgatcatacattcgattggaaacagttacttccgatctgtgtgtggtctgttcacttttcagttattcctttacaattcagaagcattatagtttatgcagcatcatgttaaaatattttcttatattttctgcaccttcgggatctaaaacagaaatcatcgccacaccagtatcaagaagactttgctcttttagtagttttacactggactttacatctgatgtccgatcatggtctaattccatgctgtttatgtaaacacccaattcccccaacacaatttaatgaaaagataccttttcattgtgcttggtaccattgcctaaaattagctatgtgaggactagtgcatctatttctagaatgtcagttgtgctccttttgtgtgttattttaatcacagtaccatgctgttctagttattattgctgctccctaactttttttttgagaggcagagttaggcagagagagagagaggaaggtcttccttctgttggttcacccccacaaatggctgctatggctggtgccgcaccaatccgaagccaggagccaggtgcttcttcctggtctcccatgcgggtgcagggcccaaggacctgggccatcctccactgccttcccgggccacagcagagagctggactggaagaggagcaactgggacagaatccggcgccccaaccgggactagaacccggggtgctggcgccacaggtggcggattagcctagtgaaccacggtgcaggcctgctccctaacttttgatgaggtctgttgttatctccaactttgttattatcctcggaattcctttggtcatcctgagccctttctctttctgcgtggattttagcattgttttcttgctatttctgtgcagaatgtcctgtgattttcatggaatgtgcatagagtctgtcaaagtctttggggcagtgtggatatttgaacaatgtcaagtctttaaacgcatggacatggctgcctctccacttttgtgtgctttctcccataatcagctgtagaatgctcgctgcaacatccttcactgcctggttgaatttactggcggatacttcatgttcttggagctcttgtgaatgtgactgaactactgaccattttcaaagcttgttattcgtgagttaagaggtctgtgcgtggatttggcaccaagccatgcgctgaatacttgtcatttatagcagattctggatggaatttgtacatggtcctgtatttgacgtcacaccatgtgcaagcagggataatctgattcctcctttcttacttggtactctttattctttgtctcatctagatgctgtgactgagacatcgggatgatcatgaacatgagtggggaaggtggacgtccctgtcttggtccacatcttagtggacaggcatttagcttgctccattcagtcaggtgctgtctttggggttgtcacgtgtcatccttgcagctcagtttgctgaaatgttcatcatgaggagatgtggaattgtgttgagtgccttctgcattattgagatgaccacacgctttctctcccccattctggtgatgtgacattttatatttactgactcgtccctggtgaatccactttgcacctcagggataaatcccccgtgatcatggtgaatcttggatgtgccgaatgactacactgcaagtatttatgacgactcttcagtttctaaccttcttgctctacatacagatgacgcgtctttggcccccaaaacgcaggcagtaggagaaccagcaggcacctgaacaccttcgccctggtgcagctccttcctgggaatcagcacctcagatgagacacagcgccacgaggggctgccaggggagctctggcccggttccaggagcaccagagcccaagcaggaacagcatgaccaatccctctgccagcaccatggcccagctcagggacatgtgtccgaggagccggcttagagggagtatctgcagagagccagatctgaaccatctgttgtggcctcctctgccaggggacagtgacaaggacaaagggcctccctaggcttccagcagctgagggagttgggtaatggaagcagggcatggcaggggtgggcattatgtcatctgagctccagggggctggggtcaaatggcacactggggagtgttcatctggaggcgaaaaggcacagggaagcagggctgggcctccacctgacctgttccgtctcctctctggctttttgaatacaaggaatgtatttaccacattgcaggcaccagtctgaagaaggaggaggcctaggagctccccgatctctcagcgaccattggaacccccacagaagccctgcaacagctggcagtggggagccgcagtcacaagaaaatgcaacaacagctgcagaaactgctgcatctttctctctcatgagatgtgtcacgtgtgtcacacgtgtgtggacatgtatgccgtgtctctgtggctaagtaaataagctggtgattctactgggtgaactgaagtacagcaactttaaatgtgttaacatgttatagtgccagggcctgctgacctagcaggactgtaattgtcaggggctggcgctgtggtgcagccagtaaagccacgctgcctgcagtgccagcatcccgtatgggcaccagttccagtcccagctgctccacttctgatccaactccctgctaatgtgtctgggaaagcaacagaagatggcccaagtgcttgggcctttgcacccatgtgggagacccggaagaagcttctgggttcagactggcccagctctggtcattgtggccatttggggagtgaatcagatctctctctctctctctcgctcgctctctctctctctctcgctgtgtgtgtgtgtgtccctctctataactctgcctttaaaataaataaatctttaaaaattgtctcttggatggttagcctcataaaagcacagatttggcctgagatcaggcagctgttctgtgcaccacgcatgacaactttctgacttttcagtggtgactgtgcctggccaccagctcagttctcaagggtaacccaagccagagtcaaacacatgaaggtgaatgctagcaaacattttaatgcttttgatatctttcttgggttttccgagaatcaacctttcaaattaattcctttgactttgggatttgcaactggatctgtggaaatcctcaggaaatgtagctctcatctggcagagataacataatttggcttacttggattgcaaggttctctcaaagtgtgaatcgtaggcggcagctacacttacatggttgttattgacgtcgtccgtcacgattgttttcttggtagaaaaagggactctggaagcagagggcctgcccatcgcaggcccagagccacaaggatggggggttcacagagcctctgcgcctttagggtgctgtgtgccatgagagcagtaagtctcctcgctaacggctgacatccaaattttaatcacaatgatgtgaacacttttctcagccgcagctttgattctcctctagaaaccatcaatggcatccgggtttgaatcgtgatggttctaaggcttctgtcacccatggctctgattcttctctagaaacaaccaaagaagagtccagcaaatgtttgtaaatgcaggtttctaatttaaaaatcagtgttgaagaattctgatatggaaactgataatggagctcaaataaaactagaaatataattacctaagactcaagaaagtgatcaagtttgtgggcctctatgtcttttacttaagaaattggtggctctatattcaaatgcatcatcttctgggctgaaatattttctgagatttgcagggtttgcatcactttggtagtataatactcctgctgttaggttgcagcacttttcattgttttcaagatacaagccgggtttgtcatgctcatgttccacagaagtacagttcccaacaagacagcgctggcctggcatgctgagaactgataaacttcattttaacaatggactccggataagcataacctgaggactcctcctctttattggttaaaatgtggataaaagtagtttttgatactgactgttcaagctgtcaatcagttgccacccaacatgggaccaaatcagaccaacaaccacgaccaaggccatcctggcaaaagggacaaacagaacccagctacaagtgactgattagcaatgatttttccataaaagaggtcacaagaggaaaatatataagttaagaggggctggcaccgtggctcacttggttaatcctctgcctgcagcactgacatcccatatgggcgctgggctctagtcccggttgctcctcttccagtccagctctctgctgtggcccaggagggcaatggaggatggcccaggtgcttgggtcctgcacccacatgggagaccaggaagaagcacctggctcctggctttggatcagcacagcgtcggctgtagcagccatttgggggggggggtgagccaacagaatgaagacctttctctctgtctctctctcactgtctatatctctctacctgtcaatatatatatatatatatatatatatataagttaagatggaatcactggttccaagcctacatttaaatacataaagttgagaggttataaaatgttagcctgtgccacggctcagtaggctaatcctccaccttgcggcgctggcacaccgggttctagtcctggtcggggcaccggattctgtcctggttgcccctcttccaggccagctctctgctgtggccagggagtgcagtggaggatggcccaagtacttgggccctgcaccccatgggagaccaggagaagcacctggctcctgccattggataggcacagtgcgccggccgtggcggccattggagggtgaaccaacagcaaaagaagacctttctctctgtctctcactctcactgtccactctgcctgtcaaaaaaaaagtgttcttatgcatggttgtctgatagcaactgtcacaaaattctgccaaggctgcagcctctacagagagccaccactgagttagagaaacgtactaactagatgtgactgtggtatctaacagaacaggatgaggtgcgtgtgttggcctatgcttcctgctctgctcaggttaactctctgtcccaaagataaatattaataaaacctgggtagccatctggctcctacagactctagatcgcaaatgccctcttccaaggagcttgaaaggttttcaagttattcttctggatggtgtctaatagcaggcccggtttcacaggaattttaatgtcaggatgaacactcctagtgatagttttttgtcattttatttagggcttgaaagtcattttgtggccagcgccacggctcactaggctaatcctccacctgcagcgccggcatcccgggttctagtcctggttggggcgccagattctgtcctggttgctcctcttccagtccagctctcagctgtggcccggaaaggcagtgggggatggcccacctgggccctgcacccgcatgggagaccaggagaaagcgcctggctcctggcttcagattggcgcagcacctgccgcagctgccacttggggggtgaaccaatggaaggaagacctttctctctgtctgtctctctctctctcactatctaactctgcctgttaaaaaaaaaaaagtcattttgttatacctataaataccttgtaagtagaagtaaacaaatgcctttggcccactctctctcttagaggatagacctgaaaacgatgtatttcactatgtccaagctttcgattcctaaaccctctcctcaccaccctcctccaatggggaaggcatgacaggaggaagacaacctgactgtgacccaggaactgggtaggtttctcccttcaaaaccaggaaaggagccagcttgtctgggcactggtagatagggcagggcagtttccctcagggcaatatcccacaggacgtttaattatgggcaggcagccagcagggtattactggacctatagtctttttccatctctgatctgttaaattgaagaagttcaaatccaaaacacagcggagacactcagacaatgactgagttgcttaccgctgtctttgcaactcatcaccccattgggcagatacccagacttgccaaatattctgcctgcacgcatagcctggcgacaaagcagataagagacacaacacctccgtcaggctctcaaccccataactgtcatgccatggcgaccctaatgtggacagcgtgatgtgagaatgagtagctataggatgtgtgttctggctgggtgtggaaaggggtatattggccaatggcatgatggttgggctatcttcctagacaatccaaatgtgaagttcaagactgtgtccactccaagtcctgccactctgctgcctacccaggaaaatgagctccctcatcatgaccatctggagaccttggagactggtttctccgtgaaatggcactgccagaccaccccgccctgagccagacctgacccttttcactgaccgcagcagtttcatggggaatggacctggagcccaggtatgcggtggtcacaggacgacaagtactggaagccatgacactaagtcaggactttggcccagaaggctggagcggtcactctaatcagagctctttggcagcagaaggaaagaagatagacatggacctgggctacaaatgtgccttcgtgactagacatactcgccatgataattgcaaggaaaggaggatcctgacaacagggtttaggacattaagtaggcagccgagatcctgactctactgcagtctgaagcagagccaaacaggtggcagcaatgcatagttctagtcaccaaaagtggcctctcgggttgcaaaaggaaaccaggccaccaatctgtctgccaaaacatcagctaaaggaaagagtattcttgggccttgacatttcaacttgacttacaccaacacaagcgtctttataccaaggaagacaaggcaagagcaaaggccaaggggtttgatgggagggatgacatcaacaggtggaaatagaagtcccatggctcctccttctagccaaggccctggtcagaccctccatgggcacttgtgtggtggacacgccgcagtgtggtgccctgatggactttgtggagtcccatccagggtgacctcatctctgcaggtagcacagcagacggtacatggttgttctctctgtgtgtttggaacagccccaagaagttgtcaactagaaggggcacccaacatgaggtgacgactacaaatagactttgctcagatgcctaggacaactggggactccaagtgtttgcttgtctcagtggacacgtttttggtgtgggtagaagttcaccccaccaggacagagagatctgggacagccgagacgtggttaaggggacttgttcctaaatgtggactcccttcttctgtacgaggcaccagtgggctcctttcacctcctaagtagctcagccagcgggtggatccctcatttacagtgagagctgcgtgtgctttgcagtcctcagtctactgcagaaaccaaaaagaggcaccacagcttgaagaagacagccgacagacgacgccaagaaactggcctgaggtgggataaggccttgcacttgtcctcctggggacaagggtagcccccacaaagtgggttccagttgagtccctatggaataggatgtgggagaatcctgatgtcccgaggtaagtatgcaaatattgctttaagtgaagacaataaaaacgtgtcccggagacaaatcagatacaataactgtacataacttctgccccacagtcagaaacgccacttcgtctttttttttcttttttcttttatttatttgacaggcagatttatagacagtgagagagagagagagagagagagagagagaaaggtcttccttccgttggttcacccccacaaatggctgctacagccgacgctgcgccgatccaaagccaggagccaggtgcttctcctgatcccccatgtgggtgcaggacccaaacacttgggccatcctccacaccctcccgggccacagcagagagctggactagaagaagagcaactaggactagaacctggcgccacaggcagaggattagccaagtgagccacagcattggccccaagtcactttgtcttttcaagcttggaagctgtggtgtcctggatgaagatcagttgctgcgaagtccatgaagctgtctgggttcaagcctcgactccatcacacgagagcccaagagggtctgagacgccctcagtggctgcgtcagcctgcgtaaaagccaaagccgcccttggagctgacatctttgcttgtctgctcatttcatctacaagatggggagacgactcgttcactcaggtcaagccgactctggcctcctcaacctgactgaccagctgctggatttgccttcccaggtgccatggatcatggtgaccccttcaggcaccaagtacaaaatttcccatggcgccatggatcgggtgatccattcatcaccgggtacaggatttcccaggtgccatggattgcagtgacccctttaggcactgggtacctttcagacctgatgtatccagtgggcataactcacctcaccactggaaaatgttctgatgtcccatgccttgccctgcccctcatccacggtcatgtgtctcagataattttcaagtgtgagctcacaggaacttccagtgtccccatactcggtgtgctccattaggcttgttcctcaagttgcctgcactgtgccctgtagcccggcgggcagggcagcacacccacaggtcctctgcaatggacctcaaacactggcactgaagtggagactgctgtagccctcacagagcagtgtttgacttccatgaggttttgtggctggcagggtctgtgccattgcctgggcttcttgctctgtgtctatcaacacctcagcccaggtggaagtccgtggagagaaagttcagcagcaggctattgggttgctgcagacccttggccaccgtgccccgttttgagatggtacagacatggaattaagcaagacacagggtcactgtggcctgggggcttcccacctacctgatcttgggaaactcgtgaagagtcatccacaacataagtaaggataaaatcagagtaacattgaatatctcacattaccagtcccagggcatgttattcacagtgaacacggcaacagaaagttaggctgtttatggaaaacagttgaatgtagacattcgtacataataataggaatctacaggcgatgatttttaaatcttcatttattttcattttatttgaaagagacataaaggcagagagagagagagaaattttatatccataattccctccccacatgctcacaacagccaagagtgagcaaaccaaaagacaggagcctagaagtcagcccagatttcccgtattggcaaggaggacccagagtttgagccaatactcattgtctcccagggtacacatcggtgaaaagcaggaacagaatcagagaggccgagactgaaccaggacgcaggtgtcccaagcagcatcctgacctctgtgtcacactactcactcccctgacccccaacttgcaggaaatgaccaggggctcccaggacccccagagggagctcaggaatcactaagcccaggcccacctcagggcaagctgtggtcactggaggagaggtctgcgtcttggcaaaagtgcagttgcttctgcttgatggataagctgccctccttgatagataagctgctttctctcttgaaaccccagatctcaggctgcaagaggactggagttgagattcttctgcctctgcagttcctgcgaagaagtcgcctagcacccctgagaaatgcttgcttcccctggagaagaagcattcattcaaacctgcaaatgccttggaggggctcagggtagggcttgggcgaagctggacacaggacaacccagctcctgctctccagaacacacaacccgcagacgcagtggctgagttgtcagcacctaagcagctgccaagagctggcgtttgaaagcagtcgggtctgagcatttgccccacactttgggattaaggttcatgaaggacagctgtggtcagtgtccttgggtgccaggaggacaatggcctgacctattctctcagcagacctgaaatttgagcagcccgtcatgtgcacggatccatccggaaaccggaagaagggacatccacatggcggggatacaaaggctgagtctctgagggaggagcctgcttgcacctgctgctcaccacttacctggctttctgctccctccatgtttctggggcggtctcaagtgggcttactccccacagtgcattgtaaaatgctccaaccatagtggaaggataatggggcttccccaaaagcaaaagtactgcagtgtcacccagcacttccatctctaggtccatactcaggatgagtgaatgcaggcaggtctttgaaaagaagcacagggaacttagtggcgtaaaaaaagataatcttttcaacagagagtattaaaacaacaacaaacaagaaaaaccattaaaacgctatgatttctacagagatcaactcaaaatggattacacacctcttgtgcaacacacatcaacacaatttctagaggaagccgtggagaaaatcctgggtgtcctttagttccctttaaggtcttagctacaaccccaacataccctttataaaggaaaaaatatgaataaatgcaacttccttattattccaagcttcagcgtgtgaatgacactgtgatggaagcggaaggaggggaaggacacatctcaagaagcacttgcgcccagagcttaggaagactagggcccacagtgtggcgtagcgggtaaagccgctgcttgcagccccagcattccataggggcgctgttcaagtcccggctgctccatttccaatccagccctctactatggcctgggaaagcagtagaagatggcccaagtgcttggcccctgcacccacgtgggagaccagaagaagctcctggctcctggctcccggctcctggcttcagttggcccagctccagctgttgcagccaaatggggagtgaaccagcggatggaagacctctttctctgcatctcctctctgtgtgtagctctgactttcaaataaataaataaatctttaaaaaaaaataactaaagtcagcactaagcaataagcagcccaagagaaaactacagaaagcaggagaacgacacttgcaagaagatctctgtgaaatcctgcgtctccctttcccctggccaacccaccccacccaccaaagagaagagcaaagaaaaccaagatccatctctttgctgccaggaaaaacatccacttctggacagggaaagggagagataagaaagcacaggcgtggtctcaagctgaggtcctcatgcctgaagagataggaccacccctgagaccagcacccttcccagccctcccaagacagtaaaagagagaccaccagggaggccactgcaggaaagcccaagcccaaaccacgagatggccctcaccatggccagggacagcaccgtgggcagctttgcttcgtgcgcatccacagggaaggctctcctcccgtttcgtgcagctagaattgagatgcatgaatacctttgcctggcgcctcagcagggacagggtttggcaatgagtgaccacagggtcaggagatctcactgaggataccctggacccccgggctcccagccaaaagagatggatgggcagttggagacccagggagactcaaagtgctggatctgggttggctgaccttgtccccaggctccgagcagcatctgttccacgcccgcggtaagtggcctctgctccaggccagacttgtgtgtgtgagtgcatggccacggtgtcctctctctgctagaacaggagaaattcctcccgcagaggggaaacaagatggagacatgcaaacagggtcaaagtcacctgcctccgcccgtgtcaggggctccctcgtgggcctggtgggtagcttgcagctctatggaggggcctccctactgtgcagactgtaaggagggccacgtcccagtgccactgacaaaacagcagagccaggagcagccaccaggtgtggccaaggcccaggacacatccagagccctgaggactcaaggacagcagcccccagtgctcactgctgcgtgtggatccagggaaacaaaggaaacctccaactgcctctcggcctgctctggcccctgcatggacctggggagctgcgagacccagcccaggggagagcccacaggtgcactgctcagtgggggtgagacagacgagtcctgtgtggagattcatgacagccagggtggcgtgtggcatgtgcaatggcctgccctgtgctacaggcctaactcccccaacctcagggggaagggtgagccttggaactgcacagtgccacacagagcccagggggcagccctctggggtcaggaccatccctgacagagggcgagaggttgaggggcttgaggcaagccttcccctgagccccacccaggggcagactcaggtggctgggactgcatcagcctagcctcccactgcccccaggccgagtgggctatgatgccctccatggggtacaggtgctcccagtgcacgggaagcagagggaacaggatccagctgggatctggtgtggcagaagagggcctggctccaccagcttgtccagggcaatagggctgaggggcccccatagggtctgggtccttgtcctaggacctgagacagcgccctcccagggagaaggcgtctttgcgtggagagatggagaaccaacatgaggaagtaaagtagtctcagcgtccctctggatgggaccatgagagacagcatggacagaggccccgtggaggccgggagaggacgtggacagtgcaggcaactctccagggcctacctgcaacagctgggccttggccctgtgggattctctgacatccagagccctctgtgcccatggtgaggacagccacggcacaccgtgcaggccccgggaaatgtcactcagagccagcacctgaccccatacaactggcaaaatcttacccacacccagaccacccaacccacatccacaccaccaccacccacacccatgccaccctcactctcacacccaactcagctctcggcagcatctgacctcttgtcccatggtcagacacccgctagggtcagactccccttctacatcccctgagctgggggctttgtttccgtcaggcactgacctccttggggcagtaccactcctgagggggaccctaggagttggggagttggctctggtctctccaaggtgctgctggctcccctcacagccttgggtcccacgcccatggctcaactgctgggtggtccttccctgtgctctgaccactcacacctgccatggctgacacgtgccctgggcacatactcactggctccaaaacctgaaaaggaagccagcccctgcacgactctggaaaatgtgagctgtgactccatccagtgacagccacagagcaggagctggggtcctgctcctgtccccggcttggaggggccaacaacaggacctgggcagctgatggacagagggcttttaccttgggatgtaggtgtggaggcccggagaccccaccaagagcctcagggaagtgtccaccctactggagagaggagagtctccgtgctgtatcttgtccctggacaaagagtgtgttccgggctggtgcagggagcctgcagtgagaggggccaagacctccaggtgaggccagagtcaggagagggcagcagagcttcaacccactgaggactggaggggctgggccgggtgccagggctgggtgccagggctgtgtcactgacccacaaacagaggcctgagaggctgaagcagaactctgtgcgtctcagggctgagcccaaagacaagagccttggaccacctggagagaccgcgttgaatagcagctgaggcctgcagtcctcacccagggaaggctgagtcccttggacactgaggcccagggctcagggcaggggccctgctgggaagggtcccatttaccaggatttccactgaaagacagctcatgagcctgcctagaacagtgagtccaacacagccacacaggaacctggaaaaacgcagactgcacttgacacagaagtcaacgcctggacacagcagtgagaacacagcctcagtgtccatgcagggtggccaaggggtctgcagcagaggacctgggagccttgagcttgggatgggcaaggacatgacacagcactctctgcacccacaggtcctggtccatagaattctcagaggcagagtgtccacagggatgagcaacctgccactgcaaagaccagcacttaggagccagcacctcacagccagcacacacagcccagctgctcaggggccagcacctcacagccagcacatacagcccagctgctcaggagtcagcacctaggggctagcacctcacagccagcacaaagagactagctgttcaggagccagcactggggagccagcacctcacagccaactcacacagcccagctgctcaggggccagcaccccacagccaacacacacagcccagctgctcacagtcagctcctcacagcccagcacacacagcccagcagacacagtctggcctaatccgctgtgtctctacaattcttgagtgttgacaccctgaaaactctcacaagatttttgaagactaaagatgtaagggtccggaaagaccagattttaccacactccaggaggtgagagccctggagatgacccaagcaggggacatttgccagggtctgaatccgggtaggcatgtgcaggagggatctgcaatttcagcctccttcactctgtcttccctctctcagccatagccacagacttgtgagcaggggaagccacccatcaacctgacccggccgcaggtgctcgccacagaggccagcagggtgccctgcaggggcatggaggcctcgggagctgttcactgcccccacggccccacgccgcccgccagccccctctttgccccactctctctctctgcgaggccaaacctctcgctgctgtcagtagtccctgaaaagcctgcttctgccgcctcactgacttgcactgtgcttatctcagacaacacttggccgggagtcggggactaaagccagggaccctgtgctcaccctgtgggcggtgcaaagggttaccttgccattgtgcgagtgtcctgggtcttgtgccactaaagcaggaagccagcagcacacagaaaacacctgcgagaggcagctggatggtgagagtcagcgcccaacctggactccaacggtgcagccacaggaggccctgcaccttcctgagcctgcacaccctgctcgccaagcctactgcgggcggcacacggagcccccggctgcgctgctgttgctctgggggccgctgcagagactgggctggagtggccggcatgaaggctcaaactgtgcaggcacacatggcagtgtgcgtgagctggagcactgcgcgggccaggcagagacctgtctctctctggggctgggatgacatctccagagacatgcacatgtgtccaaggaagagaaaccgaagccggggccacagcgtccccaggcctggccgccaggggccgggccatggcaacgtcgagggctagaacacaagccacacgaggcgactggggaagtggtggagacctggatccccaccagccacccagggtcaggaagaaagcaagagaagcccaccatgcagaatgcaaacagcaagactccaagcctttccaggcctgacgtcacaggagacctcttcctacaaaaaccctgggccaccagggcggccagtgaggagggggctcctgtccggagaggggagcttctctgtcactgcccggcctcctgctggacccagacctggcccacggggctcacctggagcagacgagggatccctgcagagggctgcagctgtcttccctgagagaagccgctggagctgcagaatctccagtgaggggaaacgggggattttgtcggggtgtgtgccactgtgg

SEQ ID NO: 41 - DNA, 1460 bp, Oryctolagus cuniculus
cacagtgacacagccccggtccaaaagcccctcccacacacacgtgctctccaggctggggggcccagcatctaggaagcaaggcccattgggacccatctccatgcaaaacccattgtgcccctgcccccagagcccccacagggcacagagcaggggctgtgacggcaaagaggagcaggggctcctgcactgtgtggtgcgagcagagccaggccagctgctgcccctcgtgcacaaaggggatcccaggaaggacggctgtgggtcagaatctgcgatcttgggagggagagcccagagcagaggcaggaggcgtcctctcgcactgctgtccgcccagggccctaatgctggtgcaggcagcactaaagacagacctggagggctggtgcagaacgcggaacacagaacccgcagcagaaaagcctgctggaggacgctgacagctggctgcggccagaccgcttgggcactcagccctaccttcctccagctagaacgccccagggaacctccctggagtagggaaggtccatctgggctgactgcaccgatgcccccagtccaacgctggcagacggggagcagagcgaaggtgggtggctcttacttaaccttcctcgagtctctgcaacctacccaagccactcactgctcaaaggccccaccttgggacccagtaatggcatcagggctctacctggtccatcgacacttagtgcaagactgggcttcagggactggagctgtggaatagtaggttaagcctctgcctgcagcgctagaacaccacatgggcatcagttcaagtcccagcagctccacttctgatgcagctccctgcggatggcctaggaaagcagcagaggatgtccgaactgcaccgatgtgggagactggaagaagctcctggctcttcacttcggataggcccagctccagatgttttggccatatagggattgaaccaacagatgaaaatctctttctataattcttcctctcaaataaaaaatattcttaaaaattaaaaaaaaaaaaaatttccaaaaaatactgggcttcaacgttagcaagagcttggaaaccaagaacctcatggacagagaagctggggctgcctaagtggggaaccccaaactggaagcaaatcagacatgagcccaaggcagagcaggtgctactaagtctcacggtggcagagcaaacgtgatggcagcacaggacagtgtcacacggagtggcatggtggcttcgctttcagtgctggtcaaagaagtaaaaaacaagtccagcacagacatccacgtcgactccatccagatcagactcgctgaggatacattcccggttggagagctgcagggaagacgcaggaacagtgagctgagctcggggctgtggttttggcagaggacaaggaggcagggattttgtgaagggccaacccaccgtgt

SEQ ID NO: 42 - DNA, 1686 bp, Oryctolagus cuniculus; identical to SEQ ID NO: 38

SEQ ID NO: 43 - DNA, 4717 bp, Oryctolagus cuniculus
acagtgcctcaggccacacataaaacttgagccgtggccacccagagcccagattggtggaccagccccacaaagaggagaccccgcccagtagcctgcccttctctgaagaggccccaatgccctaaacagattctgagattctgagtggcccggatcacagtgggtataactggaactaccactgtgggcaatactgtgtcccaagctgcctccacagccacctaggcccagcacagcccacgccctgcccggtccctgcgtatctcccacagctcagaccctctgggtgttcgcatttcctagttaggatgaggtgagtgcaggagtcttgggtcccacagttgagagggctacccttacccaccccagccagaactgacccctcaggaggtatgcctcagggagacagcagtggccaggggaagcaggcatgacccccatgacaaccacagccaactgcaggagcagacaccccaaccctggagaagtgacagattctgcccatgagcccatagtaacctggacccctccagtatctacctcaatcagggtgggagctgggaactcatggggagctggtggaacacaggactttccagaatgtcaggtcaacaaaagccaggcaccagagaacagagccctctgacaggctgcccaccagcccttagccccagctccgagcacctaggttgaggcaacaccataaggatggggccccaaagcagcagccagagcccgggcccctcaacatgggggtcctccagggcggtcctctatagagggccccatggtgtcccccaccccattacctaagccacttgcaactgccaagcctacccggacagacagagagagtctgggctggggacttcagaggcacctcagaaaccagcacaagccttcccgcccccgacccaaacccgtgcccacctgtgtgggtcactcacctcccttcctgggtgaagaggccttgcacctatgtctcagggccagcgcaaaccacaggatagggggtagtggacccaagggcagccctgacctccgccctagactccctggccccagctgcccgctgtcccggagaccagggactctgcatttccagagcttcagggcagggcccagcctccagggccgccccctccgcctccccccaccccccatgccaaggtcaggaagagccagggaacagctctgcacgaaacaggcttcctgccaggggctctggttctcccagcctgcagtttctccttccttccttcggggtaacggccagagctcccctcacgcacccctcctccacccagctgcagcctcagcgtgcctggctcgggcccagcgctgtgcagagaggaagggcaggacggacacagcacaggcggctgggacccagaacgcgcgctcagacagccttctaggggtctctctcgatgcccagaattgccctggacaaggaatctaatgcccactgcaggtcctagtctcacccagagataaaattctaagtggagacatagtagcaagtccagataagaacaccattcatttattcaaagtgagatagaaaatatgggagcgaggtctggacccagtagatgagtgtggtctgccccaacctaattggagacaaaaaaaaaaaaaaaaaaaaaaaaaaaaaaaaaaaaaacacttcaggaagagcagtaggaaaaaaaaaacagaagaaaaattaaaaataagacatcacaaaaggacattggtggggtcggcgctgtgacatagctggtaaaactgagcctgcagtgccggcatcccatacgggttccagtacaagtcctggttgctccacttccggtccagctctctgctgtagcctgggaaagcagtagaagatggcccaagtccttaggcccctaccccgacatgggggacgcgacttaggatcggtgcagttccggaactagcagccaactggggagtgaaccaggggatagaagacctctctctctctcattctctctttctctgtaactctgcctttaaaatgaataaataaatttttaaaaaaaaaagtgcaggggagagaggaagaatgtgacagaattaaagagatgaaacagatactgccggccaggaggagagaagcaacaaagtgtggctccggcctgggcactggcatcccatagacaggtgccacttgcagtcctggctgctccacctctgatccagctcctgctgatgtcctgggaaagcagtgcaggacgtcccaactgcttgagccactgcatccacataggagacccagaaggatttcctggcccctgacttcagatcagcccagctctggccctaaaggccatctggggagtgaaccagtaaatggaagatttcgctctctctgtgtgtgtctctacctctctgtctgtaacaatactctcaaacaattagatcaaccatttataaaattaaaaaataaaatatttccaaaaaatactgaggttcaaacattagcaaaagcttgggagccaagaacctcatggacagagaagctggagctgcctatgtggggaaccccaaactggaagcaaatcagacgtccgcccgaggcagagcaggtgctactaagtctcacggtggcagagcaaacgtgatggcagcacaggacagtgtcacacggagtggcatggtggcttcactttcagtgctggtcaaagaagtaaaaaacaagtccaacacagacatccacgtcgactccgtccagatcagactcgctgaggatcacattccagttggagagctgcacggaagacgcgggaacagtgagctgagctcggggctgtggtcttggcagaggacgaggaggcagggattttgtgaagggccgacccaccgtgtagctacgatgactatggtgattaccacaatagtgcacccagcacaaaaaccctcagggacctgcagcccacaggctcctcgctgacagcctgaacatctgggagcagccagtgtgcccctcagctgagctcagcccctcaccctgaggccatccctctcactgccccacacccccagggtgcccagccagaacaggccatagggtcaaggtctctatcactgtgcctatggggtcctggttcccatggctatggggttcacactcaaaaccagctgcacatacaggggctgagcccaccccctaccaccagactctcaacagctcgggggccagagcagaccccaatttctcaggcttagagtccacccccaccgggccagagcagaccccaattgctcaggcttagagtccacccccaccagtgttcacctctcctgtccttcacccctcacacagccagcagcccagcccccacaaacatgatgcccacaccagaggggcagccctgccctggggtggcctctgagtcccaactccagaggacgtggaggacgaagaaggcctttgttgagctcctgctcctgggttccagctcatcccagggcccacggcttgcacagaaaggatgggtcccctgggtgccccaggccccagttctcactccctctgctcttccctcatcagccctgtatgaggaagcaccaggaactgttaccatagaatggcagggctcttgtctttgcgcaagaaagaattcaggtgtgagacagagagtaagtggaaaacaaataccaagatttattagggtagggacatccgtaggaatggatgggcaccactccagacagaacctaaaagagagtgcccagtcactcagactgggggagagcgaggttacatggttgagtggagagagtacacctggggaggcaggcgggcggctcagcagagagggagagggctgagcgcgcagtctggttgaggccggggtttttaaggggctcggtctcgcctccccacctctgctcctgctggaacaaaggactttttggatgtaaatatgaaaaactcctatctgagttttccccctgaagacagggggaagggtgggaagacagggaaggcagaagggtgggacccccgcctggcaggttttcgagaagactttgagatacatatgctggacctagatgtcagctctttaggtctttgtcacacacacataatctgacttcctacctaacagaacctccgaggggatgagacggtacaggactgctggcgatgtggtgggagcctccagctgtcagtgctgatgtaaggtacaaaatacatagactgcccctgcggctgcctgatgagcaaacaccagcggagggggcaccacagttgatccactgcccctcacccagcctggcctatccattagaccagcattcccaccatcgggcctctcccatgtccccgggagccacagggcaggtgcagagagacacacgtgtggagagcagccaggacagctgtgtaccctggaaaggggagggggagctcagctgaggatgcccccaggtcccccatctgctactacaatctacagacccccgccccaatactttgagagggataggaaggaggaaaattttgcatggaccctctctctgttgaaaatccccacagcagcccaggtcagaccacaaaggccatcagtgaggactgtctctggccagctgcagccccagagccctggcagagggcaaccccctccaaagcatgaagaccagagactcacagcattgctctgggctgcaggggaatttgtgctggtctgagacaccgtgg

SEQ ID NO: 44 - DNA, 177 bp, Oryctolagus cuniculus
cacagtgcctcaggccacacataaaactcagtctacagcctcctggttcccacactgctgaacagccccacccaaaggaggccccgcccagtagccggtccttctctgaggtggacctagctatggatttgcagaagagaagagacagggatttggtgaagggccgacccaccatgt

SEQ ID NO: 45 - DNA, 2413 bp, Oryctolagus cuniculus
cacagtggtgcacccagcacaaaaaccctcagggacctacagcccacaggctcctggctgacagccctgaacatctgggagcagccagtgtgcccctcagctgagctcagccactcaccctgagcccgtccctctcactgccccacacccccagggtgccctgccaggacaggccatagggtcagggcctcgatcactgtgcctatggggtccttgttcccatggctatgcagtccacactcaaaagcagctgccccaacaggggctgagcccacacctcccaccagactctcaacagctcgagggccagagcagatcccaattgctcaggcttacagcccaccccaccagtgtctaccgctcctatacttcatccctcacacagccagcagcccagcacccacagacttaatgcccacgccagagggacagccctgccctggggtggcctctgagccccaactccagaggacgtggaggacgaagaaggcctgtgttgagcccctgctcatgagttctggctcatgccaggcctgcgacttgcacagggtggatgggtgtgggtcccagggcccagttctcactccttgctcttccctcgccagtcctgcatggggaagcaccaggatcctccaagggggtgagcacggtgcagggctgctggggtatatggtaggagcctccagctgtcagagctgatgtcccggaggggagggctggagttgctgtattgagtctcctgggatctcttccttcaacttagtataggaataacaagccaggaaataatttgcaaagaggcagaaacttttatttgattggcaagcgacagagaaaatgtctggtccaaggggagaccaggcagagtgcccgagaggacactggctctgagagagtgtcctgggtttagggcatttctgtctgttcactgagtcattctctgggggtgcccatttcacgggaggtttctctttttttcagatttattcacggccagcgccgtggctcaataggctaatactgcgctgcaaggattgcccctcttccaggccagctctctgctgtggcccgggagtacagtggaggatgccccaagtacttgggctctgcaccccatgggagaccaggaggaagcacctggctcctgccatagcatcagcacgttgcgccggccgcggcagccattggagggtgaaccaagggcaaaaggaagacctttctctctgtctctctctcttactgtccactctgaatgtcaaaaaaaaaaaaaaaagatttattcatttatttgaaagtcagagttacacagagagagaggccttccatccactggatccctcctcaattggctgcaacggccagagctgggcagatccagtcaggagccagaagcctcttcaggtctcccatgcgggtgcagaggtccaaggacttgggccatcttctgttgctttcccagccacagcagagagctggattaggagtgcagcagccaggactccaaccggcgaccacatgggctgctggcatggcaggtgccgactttacccactatgccacagcgccagccccgagcacgggggtgtttcacatatgaacgttgcttggcttggggctcgtggagatagcaagggtctcctggagactgtctgtctccttaggggctcagcccctcccctgccagctctgggtggaagactgcacccaccctgaaggtgtgagttaaagcctcgaggtcacacacacagcacgagaagctgttagtgggggagatgtcagttggtctggagtcgggctttccagccacagccagcagcctgctggtgaaggacattctacctatgactgaggggcccaagaccacagcccaacaggctggcctcatgtacggtgcaggacacacttcatcggctgcccccgcggctgtccgctgagcaaacaccagcggagggagcaccacgcatgacccactgcccctcctacccagcctggcctggccactggcccagcacacccaccatctggcctctctcatgtcccctggagccgcagggcaggtgcagagagacacacgtgtggagagcagccagggcagctgtgcaccctggaaaggggagggggagctcagctgaggatgcccccaggtcccccatcttcatctggaacccacagaccctcccccaatgcttggggagggacaggaaggagggaaattctgcaaggaaccctcttactgtggaagaccccccacatcaacccaggccaggtcccaaaggccctcggtgagggctttctgtggccagctgctgcccaggagcccgggtaagtcaaccctctccaacgtgtgacgaccagagactcaccgcacttcaccatgctgcaggggaatttgtactggtctggagcatggtgg

SEQ ID NO: 46 - DNA, 4614 bp, Oryctolagus cuniculus
cacagtgcctaaggcctcacataaaactcagccacagcctcccaggtcccaagctgctggaacagcctcatcccagaggaggccacacccctgtagcccctcctttgaggaggcccatcctctgaacagattctcagcagcccaggatcatggtgggtacaactggaactaccactgtgggcaatgctgtgtcctaagctgccccccgaacccacctaggtccagcccagccccacaccctgcccagtccctgtgtatctcccacagcccagaccctctgggtgttcacatttcctagtgaggatgaggtgagtgccggagtcttgggtcccacagttgagagggctacccttacccaccccagccagaactgacccctcaggagggtgtccctcagagagacagcagtggccagggggatgcaggagtgaccacagccttccaccccttgaccaaagcccgtgcccacctatgtctgcaggctgctcgtggtggtcactcacctcccttcctgggtgaagaggccttgcacctgtatcccagggccaacgcaagtcacagatgggggtagtggacccaagggcagccctgacctccgccctagactccctggccccagctgcccgctgtcccggagaccagggactctgcatttccagagcttcagggcagggcccagcctccagggccgccccctccgcctccccccgccccatgccaaggtcaggaagagccagggaacagctctgcacgaaacaggcttcctgccaggggctctggctctcccagcctgcagtttctccttccttccttcggggtaacggccagagctcccctcacgcacccctcctccacccagctgcagcctcagcgtgcctggctcgggcccagcgctgtgcagagaggaagggcaggacggacacagcacaggcggctgggacccagaacgcgcgctcagacagccttctaggggtctctctcgatgcccagaattgccctggacaaggaatctaatgccctctgcaggtcctagtctcacccagagataaaattctaagtggagacagtgtagcatgtccaggtaagaacagtgtttatttattccaaggaggaagagtatttggcagcgagttctggacccaggagatgagtgtggtctgccaaactaatgggaagaactaaagaaaagtaaacaaacaaaaaaacccttcaggaagagcagtagataaaaaacagaagaaaaataaaaataagacatcacaaaagggcagtggtggggtcggctctgtggcatatctgataaagctgtcgcctgcactgccagcctcccatactggctccagtccaagtcctggcggctccacttctggtccagctctctgctgtggcctgggatagcaggagaagatggcccaagtctttgggaccctgcacccatgtgggggacctgaaggaagctcctggctcctggcttagggtcactgcagctccggtccttgcagccaactggggagtaaaccaagtgtaggaagacctctctctccctctctcattctctctctctctctctctctatatatatatatatatatatatatatgcttttcaaatgagtaaataaatctttatttaaaaaaagtgcaggggagagaggaagaatgtgacagaattaaagagaagaaacagatactgccggccaagaagagagaaacaacaaagtgtggctccggcctgggcactggcatcccatagacaggtgccacttgcagtcctggctgctccacctctgatccagctcctgctgatgtcctgggaaagcagtgcaggacgtcccaactgcttgggccactgcatccacataggagacccagaaggatttcctggcccctgacttcagatcagcccagctctggccctaaagaccatttggggagtgaaccagtaaatggaagatttcactctctctctttctctatctctctctgtctgtagccttgccactcaaacaaatagatcaatcttttataaaattaaaaaaatttttccaaaacaaatactgggtttaaaaaattagcaaaagcttgggagccaagaacctcatggacagagaagctggagctgcctatctggggaaccccaaactggaagcaaatcagacatgagcccaaggcagagcaggtgctactaagtctcacggtggcagagcaaacgtgatggcagcacaggacagtgtcacacggagtggcatggtggctttactttcagtgctggtcaaagaagtaaaaaacaagtccaacacagacatccacgtcgactccgtccagatcagactcgctgaggatcacattccagttggagagctgcacggaagacgcgggaacagtgagctgagctcggggctgtggtcttggcagaggacgaggaggcagggattttgtgaagggctgacccaccgtgtagctacgatgactatggtgattaccacagtagtgcacccagcacaaaaaccctcagggacctacagcccacaggctcctggctgacagccctgaacatctgggagcagccagtgtgcccctcagctgagctcagcccctcaccctgagcccgtccctctcactgccccacacccccagggtgccctgccaggacaggccatagggtcagggcctcgatcactgtgcctatcgggtcctggaccccaaggctatgcggtccacactcaaaagcagctgccccaacaggggctgagcccgcccctcccaccagaccctcagcagttgaggggccagagcagaccccaatcgctaaggctaagagtccaccccagcactgtctaccgctcctatacttcatccctcacacagccagcacccacagacttgatgcccacaccagagggacagccctgccctggggtggcctctgagccccaactccagaggacgtggaggacgaagaaggcctgtgttgagcccctgctcatgagttctggctcatgccaggcctgcgacttgcacagtgaggatgggtgtgggtcccagggcccagttctcactccctgctcttccctcgccagtcctgcatggggaagcaccaggatcctccaagggggtgagcacggtgcagggctgctggggtatatggtaggagcctccaactgtcagagctgatgtcccggaggggagggctggagttgctgtattgagtctcctgggatctcttccttcaacttagtataggaataacaagccaggaaataatttgcaaagaggcagaaacttttatttgaatggcaagcgacagagaaaatgtctggtccgaggggagaccaggcagagtgcccgagaggacactggctctgagagagtgtcctgggtttagggcatttctgtctgttcactgagtcattctctgggggtgccaatttcacaggaggtttctctctttttaagatttattcatttatttgaaagtcagagttacacagagagcggcaaggcagagagagagagagagaccttccatccactggatccctcctcaattggctgcaacggccagagctgggcagatccagtcaggagccagaagcctcttcaggtctcccatgcgggtgcagaggtccaaggacttgggccatcttctgttgctttcccagccacagcagagagctggattaggagtgcagcagccaggactccaaccggcgaccacatgggctgctggcatggcaggtgccgactttacccactatgccacagcgccagccccgagcacgggggtgtttcacatatgaacgttgcttggcttggggctcgtggagatagcaagggtctcctggagactgtctgtctccttaggggctcagcccctcccctgccagctctgggtggaagactgcacccaccctgaaggtgtgagttaaagcctcgaggtcacacacacagcacgagaagctgttagtgggggagatgtcagttggtctggagtcgggctttccagccacagccagcagcctgctggtgaaggacattctacctatgactgaggggcccaagaccacagcccaacaggctggcctcatgtacggtgcaggacacacttcatcggctgcccccgcggctgtccgctgagcaaacaccagcggagggagcaccacgcatgacccactgcccctcctacccagcctggcctggccactggcccagcacacccaccatctggcctctctcatgtcccctggagccgcagggcaggtgcagagagacacacgtgtggagagcagccagggcagctgtgcaccctggaaaggggagggggagctcagctgaggatgcccccaggtcccccatcttcatctggaacccacagaccctcccccaatgcttggggagggacaggaaggagggaaattctgcaaggaaccctctcactgtggaagaccccccacatcaacccaggccaggtcccaaaggccctcggtaaggcctctctgtggccagctgcaaccacagagcccgggtagaggtcaacctctccaaaggatgaagactagagattcagtactgcaccgagctgcaggggattttgtgctggtctgagacacagtgg

SEQ ID NO: 47 - DNA, 5261 bp, Oryctolagus cuniculus
cacagtgcctcaggcctcacataaaactcagccacagcctcccaagtcccaagctgctggaacagcctcaccccagaggaggccccgcccctgtagcccctcctttgaggaggcccacctctgaacagattctcagcagcccaggatcacggtgggtacaactggaactaccactgtgggcaatgctgtgtcctaagctgcccccgcacccacctaggtccagcccagccccacaccctgcccagtccctgtgtatctcccacagcccagaccctctgggtgttcacatttcctagtgaggatgaggtgagtgccggagtcttgggtcccacagttgagagggctacccttacccaccccagccagaactgacccctcaggagggtgtccctcagagagacagcagtggccagggggatgcaggagtgaccacagccttccaccccttgaccaaagcccgtgcccacctatgtctgcaggctgctcgtggtggtcactcacctcccttcctgggtgaagaggccttgcacctgtatcccagggccaacgcaagtcacagatgggggtagtggacccaagggcagccctgacctccgccctagactccctggccccagctgcccgctgtcccggagaccagggactctgcatttccagagcttcagggcagggcccagcctccagggccgccccctccgcctccccccgccccccatgccaaggtcaggaagagccagggaacagctctgcacgaaacaggcttcctgccaggggctctggctctcccagcctgcagtttctccttccttccttcggggtaacggccagagctcccctcacgcacccctcctccacccagctgcagcctcagcgtgcctggctcgggcccagcgctgtgcagagaggaagggcaggacggacacagcacaggcggctgggacccagaacacgcgctcagacagccttctaggggtctctctcgatgcccagaattgccctggacaaggaatctaatgccctctgcaggtcctagtctcacccagagataaaattctgagacatagtagcaagtccagataagaacaccattcttttattccaagtaagagagatatatgcactcgcaagtttctgttagccccccatgttacttaggcagatacaaattagcctatgtgtgtatgtgtgtgtgtgtgtgttatgtgtatgtatgcttgtgtttgtgtgtgtgcacgtgtgtgtatgtgtttgcatgtgtgtatatgtgtgtgcacaggtgtgtatgtgtgcatgtgtatgtatgtgtgtgagcgtgtgcctgtgtatgtgtgtgcatgcatgtgttcctgtgtatgtgtgtgtgcgtgtgtatgtgtgtgtgtgtgcgtgtgtgtgttaggggtctgaggaactcagcagatgcagaagctcactttggaagcagcccagtttacactgcagagtcctgcccgggtggtctcagcccttctcccccagaggaacctccccagggcagtctccctcctcggcacctcgtgggttacctggcctgacaacatgcagcaaggcaggcacccagggaagctcccctgcccagtgccaggtgggctccccagtctgacagcactgagtagtaaaacccgggaggagttttctttgtcctgggcggggaaagctggaccctttccctcagaagccgcagtctgcaaacagactctgcgctcagcactcagcccctgctgagccgcctgcctggctccgggtgtgttctctccgttcacccgtgcgaccttgctctgtccagtctcagtgactgggtgctctctcgaattctgtcccatccgttctcatggatgtcctgcctccataaacttgctacttgcctaccactgctttctgtctcatgccagagttctttcttgcgagaagacaaaagcccacactaggatgtccactaacacccaagtggatgacacctggccttggtcggggagagggaagtccagggggagagagatggagagggtccctgagtggcagccccagctgaagtccgacaagaagaagtctctcccccattctcagcctcatttgtgctgcagggagtggtgccttagcgcatgaggagctgggggggggggggtctagttttctattccaggtgtttgccttctacttacgttagcagagatgacttaagtagacgtaagtagacgactctcagtcccacactgcctctggggaggggagggggctgcaggccgagttgatcaccaacagctaatgattaaatcaattgctcgaatgtaattggtagtggggaagtaggcaggatggttaggtagcaaccggtgagctggaagatctttttacacagtttctacctgtagctctgaattgtaactccaccccttgcctgtcaatccagtatgtccattttcccacaatgcacctgtgtctcatgtgggaccaggaaggaggatatgtcatgatggcctcagggaagggaagcaccatggaactcccagaaagctttaggcatgtgaagcctcgtccaaactccacgccctttgcatgttcaactaggacaccagcccctcccacagagggaccactgcccatggtcactaggacaccagcccctcccacagagggaccactgcccgtggtcactaggacaccagcccctcccacagagggaccactgcccgtggtcactaggacaccagcccctcccacagagggaccactgcccatggtcactaggacaccagcccctcccacagagggaccactgcccgtggtcactagggcaccagcccctcccacagagggaccactgcccgtggtcactaggacaccagcccctcccacagagggaccactgcccgtggtcactaggacaccagcccctcccacagagggaccactgcccatggtcactaggacaccagcccctcccacagagggaccactgcccatggtccttttctgccttttgcttctggcccttgttgttcctccctctggcctcgtgcctggttctctcctgctaggcagctcctaggccctctggtgatggtgtctctgggtgtgggatggccctcacccacccatgagtgtctatcctgcctctcccttatagaagccctgctcttacctctgacctgtagtcatgcctctgctttgaattcttatctctgtgtgggtaagaacatgatacaattggcccacaagttcccatccgtaaggaagctgccataagaacctggaagaaaagctgtatgaggactccggagggtggagctcaaagaggacaaaggaaccccagccccacacacacctggccacacctgcacctctcctcacctggatgttcacctgtgtcctttgtaacatgcaatgtgatgaacaggaaccctaagaaaagcatttctctgagttaatcacacctaaggcaggggttgtgggagacgatttggaactgggcagtcagaagcacaaatgaaatggcctggaattgtggccagcgtccaaggggatgaaccctcaaccagtgggtctggcactaagaatttatgggtttggaggcgcctgctgaggtccctgcatgcttgcctgctgggggtcagcagcccaggcagcaggccaccagtgtgggcaaagcaagtgggggaagctgtgtttggtttttccttttccatgtttcccatccatccttgggcaccttggaggacttcacatcttggctttttgaggggtgctgcattcctgctggatccaaaggtagactttaagaaaattgaaaacttcctctatcagtaaacccaggaaacagaaacaaccccgagactccaaaataaatgcagatacccaaagtggctggcattgggcagaggtgtcgggagaggaagtgaacggccaccaggcaaatccctagaggtgagaggctcaatggcagaaaagagcctttctggaaatgaagacttctccctgcactcgctgtgacgcaggaaggcggcagaggctcaggggcatgggggaagggaaactcaggggcatgatgggaagggaaactcaggggcatggtgggagggaaactcaggggcatgatgggaagggaaactcaggggcatgatggggaagtggctcaggctcagtgcaaggtgggaagggaagctgaggggcatggtggggaagtgggtctgctaagcctggtccacatcactagtggtgaacttggattagaacaggaccagcttgatccaaacagcagcaaaatgcagcaccaaaagaaaacacatatcagaaaaaaacaatcgccaaaggataagatgaaaatgtcaagtgattcttcatgaataaaaagtgcattcctcaaggaaaactatgaagcccattgcaagactcaaaagggctgaggagtggacgagagtggcctgggctgaggaggagcaagcgaggtctggaccctggaggagacaagtgtggtctgcccaaccttacagaaagaactagaacaacaacaacaaaacacttctggaagagaggtagcaaaagcataaggaaaataagacaccacaaaagcgcaggggagaaaagatggttcagaattaaagagatgaacagatactgccggccaggaggagagaagcaacaaagtgtggctctggcctgggcactggcatcccatagacaggtgccagatggagtcctggctgccccacttctgacgcagctccctgctgatgtcctgggaaagcagtagaggacgtcccagctgctagggcccctgcacctctgagggagatccaaagaagctcctggcccctgactccaatcggcccagctctggccctaaagaccatttggggagtgaaccagcagatggaagatttcactctttctctgtctctacctctctctgtctgtaaacttgcctctcaaacaaataaattaatctttttaaaaattaaaaaataaaatgtttccaaaaatgaatacccctaacaggaagtgagctgcctatgtggggaaccccaaactggaagcaaatcagacgtccgcccgaggcagagcaggtgctactaagtctcacggtggcagagcaaacgtgatggcagcacaggacagtgtcacacggagtggcatggtggcttcactttcagtgctggtcgaagaagtaaaaaacaagtccaacacagacatccacgtcgactccgtccagatcagactcgctgaggatcacattccagttggag

SEQ ID NO: 48 - DNA, 1209 bp, Oryctolagus cuniculus
cacagtagtgcacccagcacaaaaaccctcagggacctacagcccacaggctcctggctgacagccctgaacatctgggagcagccagtgtgcccctcagctgagctcagcccctcaccctgagcccgtccctctcactgccccacacccccaaggtgcctggccgggaaaggccatagggtcagggcctcgattactgtgcctctcgggtcttggaacccatggcaatgcggtccacattcaaaattagctgccccaacagggcctgagcccgcccctcccaccagaccctcagcagttgaggggccagagcagaccccaatcgctaaggcttagagtccaccccagcactgtctaccgctcctatactttatccctcacacagccagcagcctagcacccacaaacttggtgctcacaccagagaggcagccctgccctggggtggcctctgagccccaactccagaggacgtggaggacgaagaaggcctgtgttgagcccctgctcatgggttccggcgacttgcacagggtggatgggtgtgggtcccagggcccagttctcactccccctgctcttccctcgccagtcctgcatgaggaagcaccaggatcctcagagggggtgaacatggtgcagggctgcttggggatgtggtaggagcctccagctgtcagtgctgacgtgtaaggtgcaggacacacttcatcggctgcccctgctgagtaaacaccagcatagggggtaccacgcttgaaccactgcccctcctacccagcctggcctggacactggtcagacacacccaccatctggcctctcccatgtccccgggagccgcagggcaggtgcagagagacacaggtgtggagagcagccagggcagctgtgcacccctggaaaggagaggaggagttcagctgaggatgtccctgggtccgccatcttcatctggaacccacagaccctccctcaatgcttggggaggggcaggaggaggaaaattcttcatggaccctctctctttggaagacccccccacagcagcctaggtcaggccccaatgggcctcggtgaggactgtctctggccagctgcagccccagagccctggcacaggtcaaccctctccaaagcatgaagaccagagactcccagcactgctccgggctgcaggggaatttgtgctggtctgaggcaccgtgg

SEQ ID NO: 49 - DNA, 34554 bp, Oryctolagus cuniculus
cacagtgcctcaggccacacataaaactcctccagctgtggcctggagttcagaacaaaggttgctgtgaaacagtttgaagcacatcggagctggggaactgggtttccacaaccgctcaggacgcagctgcaggaagcccctggccaccacgagaggctggagaagctgggccaagacccagcagcaaacatgaagtgtgctcagtggtaacacagacgacaggcaactgttcacctgcacagaaaagaagcactgtggccctaacaaagccagcattcggccacactcagcagccacaggtgaggacacggggtggacagctgttgtgtgtgtggctccctcctgcagccccaagttgaaggtcaccaggaaagccaaagcaagcctctgaacacagcaccagtaaatgccaaatctctagtgcccgaccaccgccgtgctccgggaggcagaggggcacggagaggagggaagacagccagtgtcacccctgcatgtagtaaaaagcagcagttcgctgtgtaaggggtacagcacaacgaagtctttagatctcgaattataaaggcaaccactgcccacgcaaatagggaaaaaagagctaaagacgtcaccaaaagagaagtttacctgggacagagcccttgtgttttaactagccttgtctctaactgacatgacgaaagctgtggcagaaaccttcccaaggtcagacaaagaaaaagcaaggcctgcgttcctggagtgcacgcggctgtgcctgccgcctgcgatgcttcccggcactcaccgtctgctcaaacgtagccctgtccggttctgctcgctggtacagagcagacagcagacggctcagcgcgtgtgagatagatagacacacacacatacataaaatctccagttaactgtggtccgcgggcagtgttctatcaagcctgcggctgccatgcaacattaccgtatccaatcgcgtgtaaccatataaaggagacaaggaggctaaagtcatacagaaggcaaaagccttctttgtgcaggactcaggatttcggataagaaattccacctgggccttatgctggcgtaataaaagactacctcttgttaagaggccttggtgtcttgtctcagtacaggaatcctgccacataccaaggggccagcaccatggcacagcaggtaaagccattgcctgtggtgttggcatcccatgtgtgcacaggttctaatactggctgctccacttctgattcagctctctgctaatggcctggggaggcagcggaggatggcccaaggaggagaccagaccaaatggcctggccctgacttccaatcagcccagctgctgctgttgcagccatcgggggagtgaaccaacagatggagaacctttctctctatctgtctctgcatctccctctaactctacctttcaaataaataagtaaatcttaaaaaaaaaaaaagtttaacaagaaaaaagcaaaaagaccctagtttattgggagtatagacaatggctataaacaacagttgaatgggaaaatgaccatttcacccatgtacagtgaatgtaaaaacaatcacagatcattaaaactatagaagtatagcattcttaaccattggttggacaaagctataaaacaaagtttacaaaagcactaagccctggggccagcactgtggcaggtaaagctgctacctccagtgccagcatcccataggggcgctggttcgagacatagctgcccctcttccgatccagccctctgccacggcttggaaaagcagtggaagatggcccaagtgcttgggcccctgcacctgagtgggagacctggaagaagctcctggctcctggcttcagatctgcacagctccagccattacagccatttgggtagggaaccagcagatggaagacctctttctctctctctccccctcccccgcctcccacctctgcctctctgtaactctgtctttcgaataaataaataaatcttttaaaaattacttgttaaacaactgttagagattactttcaggaaatcggtacatatgatgctggaatggatatttggggagcaaacctagaaatctcctttaggatttggcagtgtggaggaactttgcaaactgttacatgctcacacgttggacatgttttggaaagctacaccttacatatttccaggaagcacagggcaaattatcaataaaaataacagacgacttgcagagtgtggatggctgaattcaagatcattttctatacaatctctccaggtgttacaaaggtagacggtggagatagatcatcgagacttgccctaagacacaagccacagtgcaaacctttctcttggtacctagagaacattgatcctgattcgcaaattccatgtcactgtttctcattgggagagatctgaaatgtggaaacaaatcagtgtctggataacatggctacaaaagagaatgaaaagctggaatttttaattgtcacagtacgagaggtaatcaggctttctcgtacactgccaacaaagaaatcggaacaatgacctttgcttggatgtctccaaactctatggcccagtcacaatgctcaaatgccaccacctagaagacaaccgactccgggagtatgactcgctgaaattaaccttacggcacctggacagtaatcagagcctggacaaggcgtcaaggggatagccaggtgccctccagcccaggagactgcagcggaagcagtcacagcaggggcttcttcgaaacatcacacttccagtccttgggcccctggacccgcgtaggagacctggaagaagctcctggctcctggcttcggattggcgcagctccagctattgtagccaattgaggagtgaaccagcgaatggaagacctctctctctgtttctgtctctgtctctgtctctctctgcctctcctctctctgtgtaactctgattttcaaataaatctttaaaaaaaagagtcatggtaaagaatattcagacagtgaaacagacaacaaaatggtttctgtcaagtgcatatttagatcagattcttcaattgtaatgttgatctgctttttttaaataaaattttcctggaaatgttcagttggcattttttagtgagttagcagaagtgcaattattattccacattactggtcctgcatttcttccctaaattccatgtgggttaaattgatttttctgattttaataccacaaaatcacctgagtatcaatgaaaagttaatttttaatctcacagaaaacctctttgtgacttttctcctgatatataaagcaatccgttggcaaaactgcatgtaattttctcccatttgtaggactctgcttcatggcgtctgtgtctttgattgtcggagttttcactgcaggcagtgctacttcctgtgtctgagaacgcccagggctgtttgccaggccgagtgcacaagttctctcctctcctgttggagctactcagcaccaagcacatgcggacgcttcagggtagagctctgggccagatgtgtaaaccgcgtcccaggaactcgtcaaagaagtgggtgctgggtggaatcctttcctcttccaggagctgtgtgttaactctgtcttcagtgggcctgatgcttgaacagaccagacgtctgatcaatcagttgtttccatgctcagagtggcaggtcttactccttactgtgagaaagctcaacagtggttcaggcctggttttgttttttaagtggggaatgtgagtgacttaattcatgggtgcttttagagcctgatggataatccaattgcctttgtttttctaattaaagaactcctaaacactttgaaaagataaaatattcctaaattttaaaaagtattaagcccttttacttaatgtaaatttgaatgttatctcaaaaaagagagggagaaggaaggaaagtacgaaggggagggggaagggagggggaggggagggagggggagggagggagagggaatattattatgttcctagagttttatccatataccacattgaaactgttaaaaactaatttaaagtgcccggtaaaaattgtagaattaaaaaggaaggaaagtccagtatgggaagcactccacacagcagactcctagaacgacagtcgctgtaagtaacactctgacctcagaatcagcccttaaggcttccaggtctggctgaaaggcctgcgagagtgtttcaggcatggaaatccaggactctggcaaaaaatattctacacggaggatctctgtgaggcctcagaggaaaggaagggccatcaagggaggatgtgcttttctctgaagggaggagagaacttccactttgcttatggccgtgtccaaataccgatggagtctatggtcacgaaaggcatccatagccttggcagccatggcaagagcctcagatgatcactgacgtcataaatcagagtgttaatcgttaaaggaacaacagaagtccctgtgcacttgcttcccatgtaggacctccgtccctaatgaattgtttttttttttaatttatttaatgagcataaatttccaaagtacagcttctggaccacaatagcctcttcccccccaccccccgtgtcttccctcccatccacaacgctcccctctcccactccctctccccttcccctccgtccctaatgaattgtactatgagaatcaactgcaaattttattcccaaattgtgctctacatgttgtgtgtgggggtgggtgcaaactgttgaaatctgtgctagcgagagaagcaaggtttattcctgtgtaccgggccgtgctgcttatggcagcactggagagggggcgctgagctgatggtatgatgtgtaacagaacagactttaccacctgaaactgctgcttcaagttcagctcaggcaaagaacaaacctcaaaacaaccaacaagaccaaagaagactacacttaagtggaagacacaagaagtttgtgtctactcaacagctttgaacgagcactccccaatgctgctagtagtctgtgaggttgcctggggcagcagcggctgtgttctttattagctgggtagatcatcttctcgctctttaatactagcagctttcatcctttgaaacgtgtgctgaaacgaagagtcagcaaatgctgctgaaagtgcggtgtttgatcaccactgcaagatgagtttctccacgatggacacaacgggttccccatggcactcggcagcaccgcgtgaggctgggctgctgaaaaactgttaacctcctctggagtgattcagtgctccgaacgccaagctagactcttcttccactgttcacagtataatggcgacctgcaggacttaaaagggggagacaatgttgagtttgaagtatcatctgaccagaggactgggaaacccattgctgttaaactggtggagataaaatcagaaattctccctggggccagcgccacggctcaataggctaatcctccgccttgcggcgctggcacactgggttctagtcccggtcggggcaccggattctgtcccggttgcccctcttccaggccagctctctgctgtggccagggagtgcagtggaggatggcccaagtgcttgggccctgcaccccatgggagaccaggagaagcacctggctcctgccatcggatcagcgcggtgcgccggccacagcgcccggccgcggtggccattggagggtgaaccaacagcaaaggaagacctttctctctctctctctctctctctctctctctctctcattgtccactcttcctgtaaaaaaaaggaaaagaaaaagaagaaaaaagaaatcctccctgaagaaccaatgaacgcacaagaagtgttttatctgacttacaccctgaagttgttgaagggaatgttcagctagaaactggagataaaattaactttttaattggtagtaaacatgctggtgctgtaagtgctcccaacattatgctgttggaaaagaagcaagcccgctctcaggagtggtgtgtgccgtgaaggaggtgtttggctttattgaaagaggtgatattgtagaagaaatattctttcactatggtgaatttaaaggcaacatagaagctttacagcctggagacgatgtggaattcacaatcaaggatagaaatggtaaagaagttgcaacagatatcagactgttgcctcaaggaacagtcatttttgaagataccagcactgaacattttgaaggaactgtaaccaaagttatcccaaaagtacccagtaaaaaccagaataacccattgccagaacgcatcaaagttgactccgtgattcctaaagaacttccctttggagacaaagatacaaaatccaaggtgaccttgctagaaggctaccatgttagatttcgtatttcaacagatcgacatgacagattagaatgtgcaaccaacatagaagttctatcagatacatttcagttcactaatgaagccagagaaatgggtgtgactgctgccatgggagagggttttggtttcgccaagtgtgtggaccgcgatgctggtgtcgtctgttcttccccctcagggttttggtttcgccaagtgcgtggaccgcgatgctcgtgtcttctgttcttccccctcagggaaagtctgggtgggaaccagctccatactgcagatgaagcagagtttactgtggtgcctgacatgttctctgcccaaagaaatcatgctgtgaggacagtttcattccactctcattcactgtagaaaaagaagccacttgttccaatcctaaaaccaccagcccaaataaaggcaaagaggagcctgaagatggcattattgctcatgacgatcgtggggtgaaactgactatcgctgctcaagccaagggtgtggaaggatctacttcctctcaaacaggagataagattgaatttagtattagcgacagaggcctggccagcagattgcaacttgtgtgagacctttaagtcgtaattcccattccaagagactcttgggttatatctgaaggataattttggatttattgaagcagccaatcataataaggacatctttttccattacagtgagttctccggtgatgtcaatagcctggaactaggggacatggtcgagtacagcttgtccaaaggcaaagacaacaaaatcagtgctgaaaaagtgaacaaaacgcactcagtgaatggcattcccaccatctactctgggaaagccattcgcccctgaggagtgtcgatccaacacagccagagtaccaagtgattgagactgtggaggaaggggatgtgaagggtgaggtctgtccatctggcatagatgggatggccaacaaagggggttgcatgcaggaggggagagtatcaagttccagttgtgtgccctgggtcagaatgcacagactatggcccccagcatcatgcccctgcgtagggccacggtggagtgtgtgaaagatcagtaactatgaagcaggagacagcgagaagctcttcttccacgggaaagccgttcaggacggcatcgagctccaggcacagatgaggtggagttctcagtgatcttagtcagaccctggcaagtgcagcacctgtaatgtttggcgggtctgagagggcccccaggctgttacagcccctccacctggtcgcttggtcaatctttgaggaacatcacccttgatgatgccaatgctcctcgccttatggttctttgtcagccaaggggaccggataactcaatgggatttggcacagaaagatccatcaggctggtgtcgttgactaaccacatccacaaagcacatcattaatccactatgctcaagttggggggattctggtgaagggttttgagtatctccctcttcatccctcccaaaatctggaatgcttattctcttgagcttttacaccagtttgaacaccttcctcatgttatgtttaaaaaaataaataaatttaagaaaaccattttaaaattatgcacagttgcagcctggaaaacttaaggtgacgccttatagtatcaattttgggaactttatttggtgcatttaacgcaactggtaatggacaaatccacttcgcctgtgtaagtgaaaagtagactgttatcttgttggccctatgaaattctgcacttgatatttagtgtaaattccacttcattactctggcaagatgttctgccttagcactcagttgcactcttttcctttccttcctgttcgttatgctttaattctgagggccatatgagggtagattatattacctttttaaaaagtacaaaaatttgtatgggcaaaccatgttcttaagttgatggctaaatgttaaaaacgttatttttcatatcatttataatcttgtcacaatccacttcacgaagtttggttaggttttaatgaaaattatcttccagagtagtttttttttcctgggatggggggtaaataactttactacaattagcatgtatggtgcagaatttcatgcaaatgaggcttgccagcagtgtgataatttaacatatttaaataaacaaaagaatgcacaaacttgctgctgcttagaccactgcagcttctaggacccagtttctttcactgattttaaaacaaaacagaaaaaaattaaaaagttgtgcctgaaatgaatcttgttttttttttgtttgtttgtttttgttttgttttgttttgttttataagtagctgcctggttcctgtgtcttgtagaataaaggtacgtgaatcttggtgtagcttctgttccaccttgtatcacgggaatggattggtctgatttcttggccctcatcttaaattggccaaatacagggtccctggccagtggactgaaggctttgtctagcatgacttgggtcagcttagggggtgcaggggagggtgctttgatcttccccattgtcctttgaggttttgatctctggataaagaggccgtttatctttgcaaacacaaaacatttttggctttctcgaattttctgttaatgtgaaagaatggaagcgaataaagttttactgatttttgagacactaaaaaaaaagaatataatctatgctaaacatggagttggttctctgtatataaaatcaaactaaaattgaagcataatgaagaaggagatgggagagggagggaggtgggatgggagttgggggggcatgggggaaagaacccctatattcctaaagttgtatctatgaaaaaatgcattcactaaataaaaacttaaaaaaaactaatttaaaaagattttaaagaaaatgcaacttaaaaatattttaaaagaaatgctgctggggccagcactgtgtcgcagtaggttaatcttctgcctgcagcacctgcatcccatatgggtgctggttctagtcccggctgctcctcttccagtctagctctctgctgcagcctgggaaagcagtagaagatgacccaagagcttgggcccctgtacccatgtgggagacccggaggaagcccatggctcctggcttcggatcagcacagctctggcccttgtggccaattaggggagtgaaccaacggatgaaagacctttctctctgtctctccctctcactgtctgtaactctacctctcaaataaataaaatctttttttttttttgacaggcagagtggacagtgagagagacagagagaaaggtcttcctttgccattggttcaccctccaatggctgccgcactgcggctggcgcaccacgatgatccgatggcaggagccaggtgcttctcctggtttcccatggggtgcagggcacaagcacttgggccatcctccactgcactccctggccacagcagagagctggcctggaagaggggcaactgggacagaatccggcgccccgaccgggactagaacccagtgtgccagcgccgcaaggcggaggattagcctagggagccgcagcgctggcctcaaataaataaaatcttaaaaaaaaaaagaaagaaagaaagaacgaaagagatgccgctgctcgggatgcctgcgtcccgtcagaatgtctggctctgcttcctgctcatgtgcactcctgcaggcagcagtgacggctcgagtcctcagggctctgtcacccatgggagaccaggactgagtcgccagcccctggctacggactggcccagccccagctcttgtgggcattgagagtcagtgaatggaagatggctgtctctgtctctctacctttcaagtaaattagaaggaacacaccccacgtgactgggactacttggggagaactagcccacatgactgaagaccacacttcagtggccagtgggtcccgtacatttataaagagttaccgggacagatgtagaggacggattacagaagttacagaaggagtacagaaggcagagtttaggacatcttccctccctggacaagataactctcgaagactccactttccttagtctctggttgcggccgtgtctcctctacagaagagacttccaaagtgctctgcacagcaggcgggagttacaaatagagcaaaaatgtgggaagcacctgggcaaactcgactgtgtcctctgtgagagcctttcaggctgtgtgccagggacagccaagcccactcagctctttgcccgctgtccttctgcagggaaggggtggggggtggagagcggaaacacagcgccctgtgcctctcctgggcggcgctgccacacccttcagggctcagagctgtagcaaggttgctgcagggaaacaggcggggctgagcggtggctctgcagactccaacggccccgtgcgtgactccggggcagcagaacaggtctgcaagggtgtcacccgctggccagctgctcagcaagtcttgggagtgggcttcttccagatccaggagctgagggagccccagggtgggtgggggggctcacccacagaatgctgacctcatctgacatggcatggtgtccagccatgcacagaggcctctggaatggtccaggaaccccaagggcactgcctcaggcaagaaatcaaggccgccctcaaaggaaaggccggaagttgccgcaggggagtggagactccaccaaccaccgtgggagagtggggcctgtgccgcctgtgctggacctctctcgcccaggctgcctccagcccaggccctcccctgcttgacctaatctactccagccttcaggcaaagaagcagtgaggtgagagacattgctggggaatctgaacttacactgagaactgcacaggtcccttttgtggtccttgggacagagtggaccaatgttatacccactggggctagcgctctggcactggtgtccattgaggagaggagctcagctgagcagaataaacctcccttctgattaagagggagagagagagagagagagagagagagagagagacaccatgccaaacctggtgtgtcaccttaggcatgccctaaaccctgaagaactgaagagagctctctggctaaacccactacaaacctctagagattcactgaaagcagacattccacttatctacaaagtcacagtacaatgataaaagcagccacagcaaaaaaaaaggtggggggagaaaaagaaaccaaagagtatctccacaaatgctcaacaacaaactcaccaatccaggaaacaagaataaggaagacagtatgacacccccaaaagagcatgacacttggatactagattgtgaagacggggagatagaagaaatgcaagaaatggaactcaaaaaattgatcataagattacatagaagtaatcaaaagcaaatgcatgaactactgaaatccatgcaagacatgaaagaaaatttctccatgaaattaagatcccaaagagaaatcaaaatgtaatgaagaattcaacagaacaaataaaaatgcagtggagagctttaagaacagaatcagtgaggcagaagagagaatattggacttagaagacagagcacaggagtatacagtcaaaccaaagacaagaagaggaaattagaaaactaatacactgttggaaatctacaggatactatacaaaaaccccaatatacaggttctaggagttcctgaagacatggagagagagaagggattagaaggcctttttagtgagataacagcagaaaacttcctaggtttagagaaaaagacctccaagtgcaggaagcacacagaactcccaatagacatgaccagaaaagatcctcaccacaacacatcgtaatccaactcatcacagtgaagcataaagaatagatgctaaaatgtgcaccagagaaatgccagattactttcaggggatctccaattagactcacagcagacttctcaacagaaaccctgcaggctaggagagaatggcaagatatagcccaagtcctaagaggaaaaaaactgacatcccagaatattatatcctgcaagctctcatttgtgaataaaagtgaaataaggaccatttacaacaaacagaaattgaaagaatttgtcaccactcattcagaggcttaaggatgtgttgcacacagaaacatggtcatcaccaagaaagcaggtaaaggaagacagtctctcagtaaaagatcacaggaagttcaaagtataagttaggaatatctttgggaaaatggcagagcaaagtcatttcttgtcaataggcaccttgaatgtaaatgtcctcaactccccaggtaaaagacacagactggctgggtggattaaaaaacaaaacccatggctcagaggcaagatggcggaataggaagggagcacactgatagtccgaggagagatagtttaataaaagtggagatactgcagtttcaaggaagagtaggggaggaaaaagcagaagaaactcttccggaatgcgtgattcacagtggacctgcgtggagagcgtgggagcccacagttcgggacaccagcggcagactcaacacaccagtgctggaacgcgaggtgagccgaacctcaatagcccgagacaccggcaggcaagcggagagaggagactagagggaacgaccccggggggggggggggggagttcaccaggctaactggaagagagagagagaaaaaaaaaaaggtgactggtacggacacgggtttctctctctccgctcacctctcaagggcgagcaagacaaagagcaggcgccatcttggacatacgtcataagcagagcgaactcaggtctgcaccggccctgagcctagcaaaaaaacctgactctgggcggggcaaattaacaggagattaggacctagtaaatttgtggcactactgaactgagactgtgaaaaaagagacggtgggggagagaactcacggaattcacctgagtactctccagagatgctacaattccgtaactttggcaacccagtgggagactgaaggagaatttgagcccactctgagggccaaacagattccctgtgtggtccttgggaaagagcttctgatctctggctcctgtgggtatatcatttgcctgctaactaactccaactttgttcagctgtgtggaattacttcccttttgaatcaaaaagagaaagagagagagagagagatttaccacgcctaacctgggagtgtcacctttggcacaccaaacagagctctcaggccacacccatctcaagccctaaggctccatcaaaaacagatagtccacttaatctagagtcatagtataacaagaaaaagcaccacagtgaagaaaccaaatatctccaatatgccaaataacaaatgcaaaaaccgaggtaataaaaacaaggaagtcaccatgatgccctcaaatgaaaaagacaccccaattcaagattatgaagatgatgacatagaagaaatgcaagaagcagatctcaaaaaattgataagaacattaagaagttctcaaattcttgaactacataaagccttaatggacaagatagaaaatctctctcgtgaaaatgaaatattaaggaggaatcaaaatgaaacgaaacaatcagtacaacaggaaactgtgatagtgactgaagtgaagaattcaatagatcaaatgaaaaacacaatagagagccttacaaacagaatgggtgaagcagaagagagaatatcggacttagaagacagagaacaggaaaggatacagtcagatcaaagaaaagaagaggaaattagaaatctaaaacatattgtcaggaatcttcaggatactattaaaaaacccaacattcgggttctaggagttcctgaaggcatggagagggagaaaggattagaaggcctttttagtgagatacttgcagagaacttcctgggtttggagaaggacagagaaatcctagtacaggaagctcacagaacccctaataaacacgaccaaaagagatcctcaccacgacacgttgtaattaaactctccacagtgaaacataaagaaaagatcctaaaatgtgcaagagagaaacgtcagattactctcagaggatcgccaatcagactcactgctgacttctcatcagaaactctacaagctaggagggaatggcgagatatagcccaggtactaaaagagaaaaactgccagcccagaatattatatcctgcaaagctatcatgtgtgaatgaaggtgaaataaagacttttcataacaaacagaaattgaaagactttgtggccacttgtccagccctgcaacagatgcttaaagatgtgttacacacagaaacacagaaacacgatcatcagtatgaaagaagataaaggaaggaaacctcatagcaaaagatcacagggaattcaaagcatatattagaacttatctttggcaaatggcagggcaaagttaccacttttcattagtcacattgaacgttaatggcctgaactgtccagttaaaagacaccgattgggatttgcttcttaacctgatgcaattttaaatgatgcttaattttgtttttaaatttcaaatcctagctcttacccatacatggaacaacaatgaaattgtacatgtaatttgccactttgctacactaacattgttccaggggtacttatgatgtacttttgaattttctatacatgcaataatgacatttgctagcagttttatgtcttccttcccaatatgtatgcattttgtatcctttctttgtgttactgcactgtctagtaattccaccataatattgaaaagtagtggtgagaaaaagacacttccccctttctccaacttaagggaaaactgtccaatttcactattaaagctggttttggtagatattctttatctagatgaggaatttctcttatgttccttgtttgctcagtttttttatgccaaatatcttctacaaaagttgatgtaatcatttaacatttttgcagtttgtgtaggatgtccaatttattgatttttttaaatgctgacagccttgcttacgtgggataaataccacttgcttgtactacataaaattgttggattttacctattattattttgctttctatttttattttgcatctttgttcatgtgaaatgtttttctatagttttcctttcttagaagttttttaaacttaaaaaattagaacttaatttagaaaaaattagaacttaaattagaatttaaatttaaaaaattagaacaattttttattaaggtaatgctgatttcaccaattgagttataaattattatctacacttcagatctcaagaggaaatggtagagagttgtccttttttgtactttgaatgtatggtagaattcaactatgagttacccttgcctgattttttcattcctttttttttggtggtggtgggaagaagtatgcatctttgattcaattcttttaaaggaaatgggccttgactgattatatttctttttgtgtaagtattggcaatttgtgtttcaagcaattgttctgttcatttaagttatcaaatttttgtgcatagtgattttagtagccccttattatccttaagtttccatggaacattaatgttcatttccaatgatggccactctttgatttctgatactggtaatttctgtctttctcttttcttaatgagcatggagagaggtttatgaatttgttatttcactgaagtatcttttggttttgctgattttcatatattattttcctatttttcaatattattcatttatatttcaattttcattccttttctttttcatgcttcagttgttcttcttgctacagtttcttaaaatttattatctgggaacattcttcatgtgttttgtgaacattcacagtttcaggtgtattttgttgtccagactatggtcccttcatggaagcttgatcttgttggacaaagaattctgtaaatattattagaccaaagtaattgataaggctattaaagccaaatttatgcttctggttttttgcatttttgaacagccaattaatggaagattgatgttcccaaatataatagtggaactttctctctctccttgaaattttgtcaatttttaaaaaatatttatttatttgaaagttagggtgtctgggtagagcaggagtggggagagacagagagagcacacgcgcacgcgcaagagagagaaagagagagagaaacagaaagagagagagatcttccattcactgtttcacacttgaaatggctgcaatacctggagctgggcaggcttaagccaggaattccatcctggtcaaccatgcagcagaaagacagagagatggattgagaggggagaatctagaattccaaacagcactccaaaatggaatacaggtgtcccaagcagtggcgtaccctgctttgccagaatgcccaccctcattctgtaggtttttgaagtgtattttgcagttctgaatttaggtgtatacacaaatttgctaggttttaaagcaatggctgcctaatcattaagtaatcttcctgtttgtctctgataattttccttgttctgaattccatttatctgaaattagtgtagtacctccagctttctttcaattagttttaacacatcttttgctatcgctttatttgaacttgtctgaatcagtatatttagtgaatgtccaaaagacaagaagttattatactcactttgtcaatctttatcttttaatgaatatatttaaacgattcacatttaagcctttaaataagaagatggttttcatcctatttcacaatggttactgttcctcttccctgtcatagctaataaatgatgtttctaagccctttactgtgaaaagttggtgggattcctcaagataaagcaaagtattggatccctaagtccatgttgcctgggagtttcccattcatagtaggaatggcctccagccactgggtaaaattgccttcacacaaagttaccctctaagtgcttcagccagggctctgttccagataagcaggtcccagctgtgattccagctttacgacctttgatgattcctgggtgctcattgcattgtaactgcaactccttagtgtgcccagagaagctgttgatatttgttttgtttagcttattattgttgtaatgaggagagtaatgactttcaagtcttttcatttcggaaatgatacttgaaagaacttccactttgactgtgacattgtctaaataagatcggtgttggagcctcgggtgattactgacgccataaataagagtgtcaattgttaaatcaacaacaggagtcactgtgcatctactccccatgtaggatctctgtccttaatgtgttgtactatgtgaattagcggtataactaatactcaaacagtactttacactttgtgtttctgtgtgggtgcaaactgttgaaaaccttacttagtatatactaaattgatcttctgtatataaagataattaaaaatgaattttgatgtgaatgggatgggagagggagccggagatgggatggttgcgggtgggagggaggttatggggagaaaaagctgctataatccaaaagctgtactttggaaatttatatttattaaataaaagttaaaaaaaaaacatctatttgctgtctacaagaaacacatctcatcaacaaagatgcatgcagactgaaagtgaaaggatggaaaaagatattccatgccaacagaaaccaaaaaagagctggtatagccacctgaatatcagacaaaatgtactttaacacaaaaactgttaaaaaagacaaagaggggcactatataatgattaacgggttgattcaacaggaagatgtaactattataaatgtatatgcacctaattacagggcaccagtttatttaaaagaaatgttgagggatttaaaggaagacatagactcaagtacaacagtattgggggactttaatactccactttcagccatggacagatcaaccaaacagaaaagaaacagcagaattaatcaacactatagaccaaatggacctaacagatatcctcagaacttttcatcctacagttgcagaatacacattcttctcatcagtgcatggaactttctctaggattgaccaaacactaagctgtaaagcaagtcttaacaaattcaaaaaaaaatcaaaatcataccatgcatcttcttggtctacaatggaatgaagctggaaattagaaactcaggaatctctagaacatgtggaaacacatagagacttaacacatgctcctgaatgaacagtgggtcatagaagaaatcaaaagagaaataaaaaactttctcaaaacaaatgaagataaaatacaacatatcaagacttataggacacaacaaaagcagtgttaagaggaaagattatagaaataggtgcctacatcaagaaattggaaacgcaccaaataaatgagctatcaatgcatttcaaggatctagaaaaactacatcaaaccaaacccaaaattaggaggagaaaagaaatattaaaattagagaagaatcaacaaaattgaatccaaaaaaatataaaagatcagtgaaattaacagctgtttttttgaaaaaataaacaaaattgacacaccattggcccaactaaccaaacaaaaaagagagagaagacccaaatcaataaatttagaaatgaaaaaggaaatataacaagacaccacagaaataagaagaatcatcaggaattactacataagctgtatgccaacaaactgggaaacctagaagaaacagatagatttctggatgcatacaacttacctaaattgagcgatgaagacacagaaaacctaaacagatccataaataagtcagaaactgaatcagtattaaaggccctcccaacaaagaaaagcccaggaccaaatggattcactactgaattctaccagacgtttaaagaagtaactccaattcttctcaagctattcagaacaatcgaaagagaagggaattctcccaaactctttctgtgaagccagcatcatcttaattcctaaacctgaaaaagatgcaacagagaaagagaattacagaccaatttccctaatgaatactgatgcaaaaatcctcagaaaaattctagccaatcaaatccaacaacatatcagaaagataatccaccaagaccaaggggatttatccctggcatacagagatgattcaacatttgcaaatcattcaatgtgatgcataacattaacaaactgcagaagaaaaaccatatgattattttaatagatgtataaaaagcatcttataaaatacaacactctttcatgatgaaaactctaagcaaattgggtatagaaggaacattcctcaacacaatcaaagcaatttatgaaaaacccacggccagcatcatattgaatggagaaaagctggacgcattcccactgagatctggtaccaaacaggtatgcccactctcatcattgctactcaatatagtactggaagttttagccagagccattagtcaagaaaaagaaatcaaagggatacaaattgggaaggaggaagccaaatcatccctatttgcagacaacaggattctttatttagaaaatccaaagaactctactaagagactatcgaaactcatagaagagtctggtaaagtagcaggatttaaagtcaatacacaaaaatcagcaacctttgtatacagatacgatgccatggctgagaaaaaatttctaagatcaatcccattcacaatacctattaaaagaaatcaaataccttgggataaatttaaccaaggatgtcaaagatcactatgatgagaattacaaaacattaaagaaagaaatagaagaagatacaaaaaatggaaaatcctccgtgttcatggattgaaagaatcaatatcatcaaaatgtccattcttacaaaagcaatttgcaaattcaatgcgataccaatcaaaataccaaagacattcttctcagatatagaaaaaaatgatgctaaagtgcatatggaagcacaggagaccttgaatagctaaagcaatcttatacatccaaaacaaatctggaggcatcataataccaggtttcaagacatgctagagggcagttataatcaaaacagctgggtactggtacagaaacagatggatagaacaatggaacagaaaagaaatgccaaaaatcaattcaaacatctacaaccaacttatatttgatcaaggcctggagcaaggacagtctattcaacaaatggtgctgggaaaactggatttccacatgcagaagtatgaagcaagacccctaccttacaccttacacaaaaatccacccagcatggattaaagatctaaatctatgaccaacaccatcaaattattagagaattattattagattattattagagaacaaattattagagaacatcggagaagctctgctacatattggcacaggcaaagacttcttggaaaagactccagaggcacaggcagtcaaagccaaaattaacaattgagataacatcagattgaaaagtttctggatggcaaagaaacagttaggaaaatgaagaagtaaccaagaaaatgggagaaattatttgcaaactatgaaactgataaaggattaataaccagaatctacaaagagatcaagtctctgctatggccaaggagtgcagtggaggatggcccaagtacttgggccctgcaccgcataggagaccaggagaagcacctggctcctgccttcagatcagtgcggtgcgccggccgcagcgcgccggccacggtggccattggagggtgaaccaacggcaaaggtagacctttctctctgtctctctctctcactgtccactctgcctgtcaaaaaataaaaaaataaaaataaataaataaagagatcaagaaactccacaacatcaaaacaaacaacccacttaagagatgggccaaggacctcaatagacatttttcaaaagaggaaatccaaatggccaacagacacatgaaaaaatgttcaggatcactagccatcagggaaatgcaaatcaaaaccacaatgaggtttcacctcaccccagctagaatggctttcatacagaaatgaactaacaacagatgctggcgaggatgtggggaaaaaggtgccctaatccactgttgatgggaatgcaaactggtgagccactttggaagacggtttggagattcctcagaaatctgaatatagttgtaccagatgacccagccatcccactcctgggaatttacccaagggaaatgaaatcagtaaatgaaagagctatctgcacctccatgtttattgcagctcaattcacaatagctaagacatggaatcaacctaaatgcccatcagtgtaagactggataaagaaactatgggatatgtactctatgaaatactacaaagtggtaaaaaaaaatgaaatccggttatttgcaacaaaatggaggaatctggaaaacatcatgctgagtgaaataagccagacccaaagggacaaatatcatatgttctccctgacctgtgacaactaactgagcgtctaaaaggaaacttgtagtagtgaaattaatactacgagaagcaatgacttgatcagcctttgtcctgttaggaaatagtttattatttttttttactattttctttttctacttaataccattggttgaactcttaacacataattactcacaagtgtttagatccaactgaaaattgatcccaggaaaaaataagagtgggaataagagagggaggagatgtacagttcaacacatgctccatcagacttacccctaagggaaaagctgagaacttgccatgggactccaaagcccactaagtcagatggtactagtgccatcttactagttaaagtgatcactttaaatgtaactgattatatagatagaaataagttcaaagggatcacacaactaaaaccaagtgtcttcaaataacaatagatagaattaaaaaggagagaacgaatcaacatggggagggggtcacacagcagatgcatagaatgacaaacgctctaaacagcactctggcctcagaatcagcccttaaggcattaggctctggctaaaaagcccatgagaggagagcagcaagatggcggaacaggaagggagcacactaatagtccgggaagagacagtttaataaaagtggagatactgtaggttcaaggaagagttggggaataaacagcagaggaaactcgtctggaactagtgattcacggtggacctgtgtggagctcatgggagcccacggttccagacaccagtggcaggatcaatgcaccagcgctggaacgcgaggtgagtcgaacctcaatagcctgagacactggcggaaaagcagaaggaggagcctagagggaacgaggcttgaagccccgtggggaaagttcaccaggctaactagaggagagagagaaaaaaaaaaaggaccagtccaaacacgagtttctctctctccgctcacctctcaaaggcgagcaagacaaagagcaggtgccattttgatcatacgtaaaagctgcgtgatcccagggctgcacctgcccacagccaagcagaaaaacctgactctggggggagtggtgaaataacaggagattagaacctagtgaatgtgtggagctaatgaactgagactgtgaaaaaacagacggtgggggagagaactcacggagttcacgtgagtactctccagagatgctacaattcggtaaccttggcaacccagtgggatactgcaggagaatttgagcccacactgagggcagaacagattccctgtgtgatccttgggaaagagcaggcgaatgttatacccacaggagccagagatcagaagctgactaccttcaattctgcacagctgtgtggaattatttcccttctgaatcaaaaaaaaaaaagaaagaaagaaagaaagaaaagaaaagaaagagagagatttaccatgcctgaactgggagtgtcacctttggcacacccttaaccctaaggaaccaaacaaggtctctggccacacccatctcaagcctctaaggctccatcaaaagcagacagtccacttaatacagtcatagtataacaagaaaaaaacaccacagtgagagaagaagaatccaaagaatatctccacaatgccaagcaacaaacacagaaaccgaggaaacaagaacaaggaagacattatgacacccacaaatgaacaagacacccaaagccaagattatgaaaatgatgagatggaagaaatgcaagatatggatttcaaaaaatttatgataagaacatttagaagttttcaaaaacaaatgcttgagctatggaaatccttactggacaggatagaaaatcttgtgaaaatgaaatcttaaggaggaatcaaaatgaaacacagaaactagtagaacaggaaagtgtgatagtgaagagtaatcaaaatgaaatgaagaactcaatagatcaaatgacaaacacattagagagtcttaaaaacagaatggttgaagcagaagagagaatatcggacttacaagacagagcacaggaaaacatacagtcaaaccaaagaaaagaagaggaaattagaaatctaaaaaatattgttgggaatctacaggatactattaaaaaaaccaacattcgggttctaggagttcctgaaggcatggagagagagaaaggattagaaggcctttttagtgagatacttgcagagaacttcctgggtttggagaaggacagagaaatcctagtacaggaagctcatagaaccccaagtaggccgacaccacggctcactaggctaatcttccgccttgcgatgccggcacaccgggttctagtcccagtcggggcactggattctgtcccggtagcccctcatccaggccagctctctgctgtggcccaggagtgcagtggaggatggcccaagtacttgggccctgcaccccatgggagaccaggataagtacctggctcctgccatcggatcagcgcggtgcgccagccgcagtgcactggccacagaggccattgtagggtgaaccaacagcaaacggaagacctttctctctgtctctctctctcactgtctactctgcctgtcaaaaaaaaagaacccctagtaaacatgaccaaaagagatcctcaccatgacacgttgtaatcaaactcaacacagtgaaacataaagaaaaaattctaaaatgtgtaagacagaaacgtcagattactctcagaggatctccaattggactcacagcagacttctcatcagaaaccctacaggctaggagggaatggcgagatatagcgcaggtactaagagagaaaaactgccagcccagaatattatatcctgcaaagctctcatttgtgaatgaaggtgaaataaagacctttcatagcaaacagaaattgaaagaatttgttgccacttgtccggcactgcaaaaaatgcttaaagatgtgttgcacacagaaacacagaagcacggtcatcagtatgaaagaaggtaaaggaagaaaaccccacagtaaaagatcacaggaagttcaaagcatatattagaacttatctttgggaaaattgcagggcaaagttactacttatcaatagtcacattgaacgttaatgacctcaactgtccagttaaaagacacagattggctgaatgggttaaggaacaaaaccgatctatttgctgcttacaagaaacacatctttccaacaaacatgcatacagactgaaagtggaagtctggaaaaagatattccatgccaacagaaatgaaaaaagagcaggcgtagccatcttaatatcagacaaaataaactttaacacaaaagctgttaggagagacaaagaggggcactatataataattaggggatcaattcaacaggaagatataacgattatcaacgtatatgcacctaattgcagggcatcggtttatttaaaagatttgctaagggacttaaaaggagacttggactccaatacaatagtactgggggacttcaatagcactctcagaaatagacagatcaaccagacagaagatcaacaaggagacagtagatttaaacgacactatagcccaaatggatctaacagatatatacagaacttttcatcctacacataaagcatttacattcttctcatcagtacatggaaccttctctaggattgaccacatacaggccataaagcaagtctcagcaaattcaaaagaattagaatcatacgatgcagcttctcagaccatagaggaatgaagttggaaattagcaactcaggaatccctagagcatatgcaaacacatggagactgaacaacacactcctgaatgaacactgggtcatagaagaaatcaaaagagaaatcaaaaactttctgtaagtaactgaggataacagcacaacataccaaaacttatgggatacaggaaaagcagtgttaagaggaaagttataataataggtgctcacatcaagaaatttgaaaggcaccaaataagtgagctttcaattcatctcaaggatctagaaaatctgcagcaaaccagacccaaatatagtgggagaagagaaataattaaaatcagagaagaaatcaatagaattgaatccaaaaaaattacaaaaaatcagccaaacgaggagctggttttttgaaaaaataaacaaaattgacaccctattggcccaactaactaaaaaaaaaggagagaaaagacccaaatcaataaaatcagagatgaaaaaggaaacgtaacaacagacaccacagaaataaaaagaatcatcagaaattactacaaggacttgtatgccagcaaacagggaaatctatcagaaatggatagatgcctggacacatgcaacctacctaaattgaaccaggaagacatagaaaacctaagcagacccataactgtgacagaaattgaaacggtaataaaggccctcccaaaaaagaaaagcccaggacgagaaggattcactgctgaattctaccacacatttaaagaagaactaactccaattcttctcaaactattaagaacaattgaaaaagagggaatcctaccaaattctttctatgaagccagcatcaccttaatccctaagccagaaaaagatgcagcattgaaagagaattacagaccaatatccctgatgaacatagatgcaaaaacgctcaataaaattctggccaatagaatgcaacaacacatcagaaagatcatccacgcagaccacgtgggatttatccctggtatgcagggatggttcaatgtttgcaaaacaatcaatgtgatacaccacattaacagactgcagaagaaaaaccatatgattatcccaatagatgccgagaaatcattcgataaaatacaataccctttcatgatgaaaactctaagcaaactgggtatggaaggaacattcctcaatacaatcaaagcaatttatgaaaaacccacagccagcatcctactgaatggggaaaagtcagaagcatttccactgagatctggtagcagacagggatgcccactctcaccactgctattcaatatagttctggatgttttaaacagagctattaggcaagataaagaaattaaagggatacatattgggaaggaagaagtcaaagtattcctctttgcagatgatatgattctttatttaggggatccaaagaactcttactaagagactattggaactcatagaagagtttggcaaaggagcttgatataaaatcaatgcacaaaaaccaacagcttttgtatacacaggcaatgccacagctgagaaagaacttctaagatcaatcccattcacaatagctacaaaaaccatcaaataccttggaataaacttaaccaaggatgttaaagatctctatgatgaaaattacaaaaccttaaagaaagaaatagaagaggataccaagaaatggaaaaatcttccatgctcatggattggaagaatcaatatcatcaaaatgtccattctcccaaaagcaatttgcaaattcaatgcgatatcaatcaggataccaaagacattcttctcagatctgaaaaaaattatgctgaaattcatatggaggcacaggagacctcgaatagctaaagcaatcttgtacaacaaaaacaaagctggaggcatcacaataccagatttcaggacatactacagggcagttataatcaaaacagcatggcactggtacagaaacagatagatagaccaatggaacagaatagaaacaccagaaatcaaccccaacatctacagccaacttatatttgatcaaggatccaaaaccaatccctgagtaaggacagtctattcaataaatggtgctgggaaaactggatttccatgtgcagaagcatgaagcaagacccgtacctttcaccttacacaaaaatccactcaacatggattaaagacttaaatctatgacctgacaccatcaaattgttagagaacattggagaaaccctgcaagatataggtaccggcaaagacttcttagaaaagaccctggaagcacaagcagtcaaagccaaaattaacatttgggattgcatcaaattgagaagtttctgtactgcaaaagaaacagtcaggaaagtgaagaggctactgacagaatgggaaaaaatttttgcaaactgtgcaacagataaagtgttaataaccagaatctacaaagagatcaagaaactccacaacatcaaaacaaacaacccacttaagagatgggccaaggacctcaatagacatttttcaaaagaggaaatccaaatggccaacagacacatgaaaaaatgttcaggatcattagccatcagggaaatgcaaatcaaaaccaaaatgaggtttcacctcaccccagttaaaatggctcacattcagaaatataccaacaacagatgctggcaaggatgtggggggaaaagtgtcctaacccactgttggtgggaatgcaaactggtaaagccaatatggaagtcagtctggagattcctcagaaatgaatataaccctaccacatgacccaccaatcccactccttggaatttacccaagggaaattaaattggcaaataaaagagctgtctgcacctcaatgtttattgcagctcaattcagaatagctaagacatggaaccaacccaaattcccatcaacagtagactggataaagaaattatggggcatgtactctatacaatactatacagcagtaaaaaaaaaatgaaatccggtcatttgcaacaaaatggaggaatctggaaaacatcatgctgagtgaattaagccagtctcaaagggacagatatcatatgttctccctgatcggtgacaactaaccaaccacaaaaaaggaaatctgttgaagtgaaaaggacactatgagaaacagtgacttgatcagcccttgtcctgactgttgatgtacaatttaatactttatcccttttagtattttttgttctagttaatactattggttgaactctgtgattaacacacaattattcttaagtgtttacatttaactgaaaagtgatccctgttaaatataagagtgggaataagagagggaggagatgtacaatttgggatatgctcaaacggacttgcgccaaatggtggagttagaaatgtgccaggggatttcaatacaatcccatcaaggttgcatgtacaaatgccatctcactagtccaagtgatcaatttcagttcacaattgatcacactgataggttgaagagtcaaaggtatcacacaaacaagactagtgtctgcaaatactaactgatagaataaaaaagggagagaacgatccaacatggaaagtgggatacacagcagacccatagaatggcagatgtcctaaacagcactctggcctcagaatcagcccttaaggcattcggatctggctgaagagcccatgagagtattttaggcatggaaatccaagacactctggcaaaaaaaaaaaatagaggacctaaatgaaagatctctgtgagtgagatcccagtgaaaagaacaggccatcaaagaaggaggtacctttctctgaagggaggagagaacttctactttgactgtgaccctgtcggaataagatcgaagtcggcaaacccaaaaggcttccatagccttggcaactcatgacttgagcctagggagattattatttttttatttttgacaggcagagtggacattgagtgagagagacagagagaaaggtcttcctttgccgttggttcaccctccaatggccgccacggccggctcactgcagcaggcacaccgcgctgatccaaaggcaagagccaggtgctcctcctggtcttccatgtgggtgcagggcccaagcacttgggccaccctccactgcactcccagaccacagcagagagctggcctggaagaggggcaaccaggacagaatccggagccccgaccgggactagaacctggggtgccggtgccacaggcagaggattagcctattgagctgtggcactggctgagcctagggagattactgatgccataaacaagagtgtcaaattgttaagtcaacaacaggagtcactgtgtatttactcctcatgtgggatctgtccttaatgtgttgtccaatgtgaattaatgctataactagtactcaaacagtattttacactttatgttctgtgtgggtgcaaactgatgaaatctttacttaatatatactaaatcgatcttctgtatataaagataattgaaaatgaatcgatgtgaattgaatgggagagggaacgggagatgggaggggtgcaagtgggagggaagttatgggggggccattgtactccataaactgtactttggaaatttatatttactaaataaaagtttaaaaaaaaaaaagaaagcccatgagagtttctcaggcatggaaagccaagacactgtggaaaaaaaatgacctaaatgaaagatctcggtgagtgagatcccagtggaaagatggggccatcaaagaaggaggtacctttctctgaagggaggagagaacttccactttgattataccctctctaaatactgacggattttgtggaatcagaaggcttccatagaattagcagctcatgacaagagccttgggtggtcactgacataataaataagaatgtcaattgttaaatcaacaacaggagtcactgtgcacttgctctccatgtaggacctctgtccttaatgcgttgtactatgagaattaatggtcaaacttgtcttcaaacagtactttatactttatgtgtatgtgtgggtgcaaattattgaaatatttacttagtatagagttggtcttctgtatataaagataattaaaaatgaatcttaacgaagaatggcatgggagagggagtagaaagtgggacaggagcgggggggggggggtggaagggctggtatggggggaagaaccactatatccctaaagctgtacctatgaaatttatattcattaaataaatgctttctaaaaaatgaatgaatctgctataaataaaaaaaagcagtgaggggttttccgaggtcgcggggaactcaggtagagcgcttgtcactccgccaccttctgccaagcccaccgcacagcccgtcctccgaaaagctcagggttagtgcagtcatggccttgtggccatgttctgggcgaggggacgtggggcagagccaggctctcatggtggagtgcgtcagcccctgccttgtcgctccgggtgctgctgagaggccaccagcagcttccggctgtacccctccccacccagaggaaaggcccagggcatttgcacagacagcgcccccctgatggggccagtcctccagggcactgcagactccagggcattggcaaactcctcctttcttctttgggccacggtgtgaggaccaagatctgtcagagccgcatcttcgaccaccgcggcttggaaataagtttatgccgcctcttgtctcctctttagtctttcctgctcgtggcattggatggtcgcacagaggaagtctgcttcgccattcactttccactccctttggaacttcccacaactcctcccttacgtgttccttccaatctgagcagcgagcagcctgcttcctcccctcctgttcaagaccaagaggcgctgagtgccccggctgcagaggcagcgccagagagacagcgcccgccgcccccggcacaggcccagaatttagcctcagttgcagcacaaagcagaagcattttgctcctcgccaagtggtcccccacagtggagcctgctgtgctcaccaaggcacggaggcgccattgcccttggaggcggtggaaactggagcccaccagcaaagccccgtccttcctcgggaactaacactgtgtctggtcacccaagcagactcttgcatgaactctgatttctctgcctctggatgtcatggtcccaaagctgagcaaatgtggatcccacctccctcaagcctctctctcccagccagggagcccagcccaagagagaactgggtggctggagcagaccctccactggggatccagccctcagctcagccacaggcctctcagggcagccaagccaagaaccttcccccaccacacaaggcactcgctggagcctgtgcctgccacagcgatgtcccctccctgaagtgtggctgtgtgttcccaaactgggcccctaggtgttggaataaagctggccccacatggaggaccctaggccaagacatcccacacagtgttgctggggcccacactaggaggctcagagggctatgcaaaggcccagggacccaacaggacctgctgggctccgagaggggagcaggactctgcacaggcagcgagtgcagaggcaaggccagggctggccaggacgcggaggcaccttccctcccccgccgggagccacagctccagcacaggagcaggtgcttccggaagggcaggggtggcccctcccccttgttccccagtgcttagaccacgggaggaagagccttctggaaaggacccaggagctcagcgagtctcaaagagcagctgggccccagcaggggagatgggagcgtctccaggttggaggcaagaggccctaagaccaatgcccatgccacctgctctgtccccagccccactgtgtcccccaggtctcagaccatcaagccacctccctcctccttcgtccttcatcctctccccacacccaggcctctgctcaccttgaagggtcagtctgcccttgagcaagtctgcagccttccctcagtgccggggccaggacatgactcatacgctcaggctgtccagcactgtccagccatttcccaagggaccccactgtcctagcactgctcgttgtctctctgtccttcctgaaccccatgggagctgtcaccctacctccatatcaggattccctcccagatgcctcagccccgcccagccctcaccatgctggaggaaacctagagtgaaagtgaacaaacccacgcttcctgcagccccccgcacaagcgctcgggccaccgtgaaatccccccacgcttcctgcagccccccgcacaagcgctcgggccaccgtgaaatccccccacgcttcctgcagcccctcgcacaagcgctcgggccaccgtgaaatccccccacgcttcctgcagccccccgcacaagcactcgggccaccgtgaaatccccacctccactccctctccactgatcaggagctggcctctgaagcttcgccatggctgtttctctgcctgcagttggcccccgctcccccacctcaggcgtctcggcctgtgcactgggtccccttggcaggactagagagcattttcctggcccccgcagccccacatgggagctcgcacctcgctaggggcccacagctgagcttcagcacagggactgacaggtggtgaacatcagtgccctgtgaacgtcagctggagccctgtcctgaagacagccttgcccacccccaggacccagctctgcagtcaggacagcactgagacccctggcccgggaccagagctccaggggcaccacagtgagagccccagcctccctgtgaggacactgagagggaggacagggaatggggggagaggctgcaggccaccccacagaggggccagggaggcgagcagtgggccagccacgtggctgacagaactctcaggggcccaaccagagagctgcccacctcgttgattggtgatgacccaaggtgtcctcaggctgcccccacctcagtcccctccacagcagaggaatcaattccagccccagacaatgacggtgcagcacacacacctcctcctccagcctcagacaacaacggtgcagcacacacacctccttttccagccccagacaacgacggtgcagcacacacctcctcctccttctccagccccagacaatgacggtgcagcacacacacctccttctccagcctcagacaacgacggtgcagcacgcacacctcctccttcagccccagagagaaggtgcactgggcgcctacagactcaatggccactggcacaggaaatcctggccacagccacgactgacagccgaggttataggtcctgacaagctgtgtgggggtctctactgaaccagatcccacacacacccagccccaggggttttagctgagctgggagcctctgtg

SEQ ID NO: 50 - DNA, 796 bp, Oryctolagus cuniculus
cacagtgactcaacactgtgaaaacccagcctcccatctgcagcacagcccagggcagcagtgtgggctcagcttcagggaccgaaggaggctggaagggaagtggcctttgggccctgtggaaagtgaggagaacttataggtgggcagtaggtgagtcctggggcagaagtgggtgcaggggtgtgggcagaagtgggggaagaggttggaggaaacaggtgtggggcagcaaggatggggcagaagcagggtagaaagtggagtagaagtggcggagacaggggagagcagaggtggggagcagagatggaagggatagaggttggggaagcagaggtgggggagctggaggtagggagctagaagtaggggcagagatgaaggctggacagaggtggggtggacagaagtggagaacgagtgctgttggactggctggaggtgcagccctggaggtgcagccctggctgatacccgagggctcagctgacacctccactgagcagggaggccccaccccgggggccaatgagaggccaacctaggaatcccgggccccagattggccaagatgtctaggcagtgggtacaggcgctcacggtgcctgcctttccttctagtcctgggccagggtgccttgtctgcgctgcagatgcagaggctatggccggagccgaggccggggccagggccagggccagggtgggagccagggccaggcccggggccagagctggagctgtgttataaagggagactgagggaggcagaggctgtgctactggtacctgg

SEQ ID NO: 51 - DNA, 220 bp, Oryctolagus cuniculus
gtgaagcctcttcaggcccccttagtctccttagcctgggtccagggtctgcagctggctcgtgtccatccccagagggtacacaggcctctcctaccagagtctgtacccttggacacctgccagggccctgggtctgtgtgctgtgagcaggcacacgggctgtgcagccacaggtgtggtttgtgtctgggcagcaacaggggatgtgcccctgtgt

SEQ ID NO: 52 - DNA, 220 bp, Oryctolagus cuniculus; identical to SEQ ID NO: 51

SEQ ID NO: 53 - DNA, 160 bp, Oryctolagus cuniculus
gtgagtcctccctctttctgctctgagactgggctgaccgtcttgctctgggtggggatgcgatggtcagcgacacagactttctggggtggccggccggacacaggggctggcaggtgaggtttttgcacgccccctaagggtgtctacagcaatgtga

SEQ ID NO: 54 - DNA, 292 bp, Oryctolagus cuniculus
gtgagtccttgccaactctctctcctactcaactctgagcgatttttctgcattttggggcaaactgagcgggacgggtctcaggccaagaatgacttggggcagcctgggggctcaggatggggtccttgggggccacggcccttctcctcctgcctctgtgaccggaggtctctctggagttctctggtctccactatgccagccctcatgcggctcagtctgagagggtcccaggcctggccaggcactggttcttgcctggggtcctggcacggtcatcacaatgtga

SEQ ID NO: 55 - DNA, 519 bp, Oryctolagus cuniculus
gtgagtccgccccatctgacttctcttaagggggactttgggtgtcagcgtctcagtgtcggagtggctgaagagttttgggaggtcaagaaagggatcggggacaggttcccccaccaacaggggctggggctcctgctcccctgttccccgaattcagccacaggtgtcggggccaggggtcttctctggctgttctggggtatcggctatttgatcaacttgagagtttgtggggccattatgactgccggccctgccgcacccaccttctggggtcggtgcccaagcaaagactactggagtcccaaggggacttggggtccccaggctggcagtggcgtggcttctgagggccaggctggactgtgacggccggctagggagagtgcagaatcgtgacttcattggcggcaagctgagacctggacagagcagacctctgggcagccggcagcaatgccgggccaggagactggggttttgtgtggggtgaagatggaggctccaccattgtga

SEQ ID NO: 56 - DNA, 7264 bp, Oryctolagus cuniculus
gtaggaacggcctctccggggccttcattctctcctcttttctgtggccttttctgaccatcacaggttggtcttcaggatgtgtcccagaggggacctgggagggaggccaggtagagacaagggccaggtagagacaagggggtttctggtgcctttggaaaactggaataacagcggcgcgtctgtgggactagctgagccactggaagaggggctggatcttgccggccaagactgggcaaggcacaaaagagaccaggatcccatggcttgggtggcagccgcggagctcccgttgtgggactgccagtgttggctgaggcgcgtgcccagccatgtttgcagaaccacaggagtgcagactagagcacacagcggggccttttctttagaactgtgaggcgttctctgtgctgacttggagttagaattctttactggttagaaagagaacggttctgagcaaatcaaggaaggagggccgtggagccccgaagggcggctgcccctctgacagggacctagcaaggcctgggcagcccaaccgtgctgggacggcgcccaccaggtatgcagggacatggtgtccgaagtggcttctgagaaaagtggctgagaaaattgagaattaagactttttgttcatgtatattcagctttttgtgtttttttttttttttaatgtaaaggaattttaaattcttattgttcagtatctgtctgggattggcacaagacagcagagaaatggtggagtggcaccagcaggccccaatacaggactgagttttgacaaaattatttaagtttaatttttaattaattgcgcaatgccagattagtgcgtgagtgacagccaagatggccgcgcatccggccagacacctgcagcaggtggcaggaagcatgtcgcactgagagtctattttaggaagccaaaaagcaccctgtgtgaatttatagctcctgtttttgaagtggtggttttcaagtggttttcccggatccgaaagtgttgcagagcaaaacaacacctgggtagtttgcatatctaaaataggacaggggactgccagggttcctcttgtcactatttgaatttattttttcaatctgaacttagcaacttctagtttgctcaagcttagcttatcaatttctaaattgtattcatttttaaagtaagatattttagaaattaaacttacagatggtttattaatgcgcccatgaaactttttaaaattactttgttatttcttcatatggtaattaacctcaaacttcagagacctcaaagcattatttttgcaaagcctgcgaccgtcatttttaagagtctgttttctctatgattagaagagacgttttgaggcttcatttcagtatttttcaagactgcttttcaagtattcattttcgcaccagttctagctgaggtggacctaagtgtcctgagttattgggttaaacgtgtgacttggtgaattggagagccatcagacagtgcagagacaggagtcgggagctctgcagaagccgggccacccacgccttgaggtttcccaggaccgccgggtctgggggtgcagccgtggcttctggttagtcaggaattcctgtttggagtggacttggaggacccgcaggacgtgccggtgaccagccactgcacatggtgagaggggcagctgctctgccacagatctgcttctatggaaagttggggtttgatgtttctttgcctctgaaggggaacccacctttgcctggtgcctgaaagacaacctgtcttccctaagggcgcttcgaggaaacgcaggcatgggctggtcacgggtatctcgtgcagcctgccactgagcttgtctctgctcagattagtcgcggcttgccgcctgtcaggtgcccttggacttggctcagttgacagctgaactgtgagcggcgaccttgatcagatgcagactttggggtcatttttagggacagtttttctctggaggaaacagagagtccaggtttatttagaattggggaggaggggttcacgccaagggctgctcggcgggctctagagttagggaacttttctcccaagtttttactctaaatctcaggatgctcagtgagcgcagagcgccagggaacatccagccagggtggccaggtgcagtgagagatgcccgaaggagatgagatcagagcaagtcgtgcggggtcctggaatgggacagttttagctgagacagccagggacgctttatggccacattctgcactgggctttcaaaactgaacacagattcaccaaggcaggggtgagctgagctaggctggctggagctgagctaatccgagctgagctgggctgagatggacagagctgggctgagctgagctgggatgagcagagctgagctgagctgggctgtgctgggctgagctagactgggctgagccggtctgagctgggttgagctgggctgaactgagctgggcagagctaggctgagccgggctgagccaagctgagctgagctgggccaagctgggctgggctgagccgggctgggctgggcagagctgtgctgagctgggctgagctgggttgagctgggcagagctgacctgggctgagctgggctgagcagggctgaactgggctgagctgacctgggctgagctagactgggctgagcgggctgagctgggttgagctggcctgagctgggctgagctgggctgagctgggccgagctgggccgagatgggcagagctgggcagagctgagctgggtcgagctgggctgtgctgggctgagctgggctgagctgggctgagctaggctgagctgggctgagctgggctgggctgagctgggctgagctgggctgagctgggctgggctgggctgggctgggctgagctgggctgagctgacctgggtgagctagactgggctgagctgggctgttctggtctgagctgggttgagctgagctgggttgagcagggctgagctaggctgagctgggctgagctgggctgggctgagctgggctgagctgggctgagctgggctgagctaggctgagctgggctgagctgggctgagctgagctgggctgagctgggcttagctgggctgagctgggctgggctgagctgggctgggctgtgctgagctgagctgggctgagctgggcagagctgagctgagctgggcagagctgggccgagctggccaagctgggctgggctgagctgagctgagctgggctgagctagactggactgagccgggctgagctgggctgagctgggctgtgcagagatgagctgagctgggcagagctgggcagagccgggcagggccgagctgagcttggccgagtgagctgagctgagctgggttgagctgagctgagctgagctgagctgggctgagctgggccaagctgggccgagatgggccgagctgggccgggctgagctgggctgggctgggccgagctgggccgggctgggctgagctagactgggctgagccggactgagctgggccgagctgggctgagctgacctgggctgagctgggccgagctgggccgggctgggctgagctgacctgggctgagctagactgggctgagctgggctgagctgggctgagctgacctgggctgagctgtgccgagctgggccgagctgggccgagctgggctgagctgacctgggctgagctgagctgggctgagctgggcagagctgggcagagctgggcagagctgtgctgagctgacctgggctgagctgagctgggctgggctgtgcacagctgggctgagctgggccgagacgggccaagctgggccgagatgggcagagctgggcagagctgagctgggctgagctgggctgagctgggccaagctgggctgggctgagctgggctaagcttagctgggttgagctgggctgggctgggctgggctgggcagagctgtgctgagctgtgctgagctgggctgagctgggctgagctgggctgagctgtgccgagctgggctgagctgagctgggccgagctgggctgagctgaactgggctgagctagcctgggctgagctgggctgagctgggctgagctgggctgagctgtgttgagctgagctgggcagagctgggcagagccgggcagagctgtgctaagctgagctgagctgggctgagctgacctgggctgagctgagctgtgctgaactgtgcagagctggctgagctgggcagagctgggctgggctgagctgggctaagctgagctgggttgagctgggctgggctgggctgggctgggctgggctgagctgggccgagatgggcagagctaggcagagctgagctgggtcgagctgggctgtgctgggctgagctgacctgggctgagctgggctgagctgggccaagctgggccgagatgggcagagctaggcagagctgagctgggttgagctgggctgagctgggctgggctgagctgggccaagctgggccaagctgggccgagatgggccgagccgggcagggctgagctgggctgggctgggctgggccgagctgggctgagctgacctgggctgagctgggccgagttgggccgggttgggctgagctgacctgggtgagctgggccgagctgggccgggctgggctgagctgagctgggctgagctgggctgagctagcctgggctgagctgggttgagctgggctgagctgggctgagccgggctgagctgggttgagctgagctgggcagagctgggcagagccgggcagagccgggcagagctgtgctaagctgagctgagctgggctgagctgggctgagctgggctgagctgagctgggttgagctgggttgagctgggcagagctgacctgggctgagctgagctgggccgagataggcagagctaggcagagctgagctgggtcgagctgggctgtgctgggctgagctgacctgggttgagctgagctgggctgagccgggctgagctgggttgagctgagctgggctgagctgggctgggccgagctgggccgagatgggcagagctaggcagagttgagctgggtcgagctgggctgtgctgggctgagcttacctgggctgagctgggctgagctgtgctgagctgagctgggctgagctgggctgggctgagctgggctgggctgagctgggctaagctgggctgagctgggccgagatgggccgagatgggcagagctaggcagagctgagctgggtcgagctgggctgagctgggctgtgctgaactgggctaagctgagctgggttgagctgggctgggctgggccgagctgggctgagctgggctgggctgagctgggctaagctgagctggactgagctgggctgggctgggctgggccgagctgggctgagctgacctgggctgagctgggccgagttgggccgggttgggctgagctgacctgggctgagctgggccgagctgggccgggttgggctgagctgacctgggctgagctagactgggctgagctgggctgagctgagctgggttgagctgggctgagctgacctgggtcgagctgtgctgggctgggttgagctgagctgggctgagctggactgagataggcttggctgggcctggctgagccgggctgagctgggctgagctgacctaggctgagctgacctgggctgaactgagctgggctgagctgccctgggccgagctgggcttggctgggccaggctgggttgggcagggcatagctcggctgtactgacctggacagagttgggctgggctgagttgggctgagctgggcagagctgagctgagctgagctggattgagctgggttgagctgaccttgactatacatagctgagctggactgagcttagctgggctgggctgggcagggcatagctgggctgggctgagctgtacagaggtgaactgggctggtcttagcttagctgggctaggctgggctgggctggtctgggctgaactggacagagcttggctggtcggggcataactcggctggctgtgctgagcttggcatagctcagctgggctgggctgggctgggctgagcctggttgagctgagctgggctatgctgggcacggttaagcttgggtgagctgggctggccagggctgggctgagcttagctgcactgagctgattgggctgggcagagggtacagggccgggctgggctgagctgggctgggctgggcacatcaaggctgagctgaactgaccttggctggactgagctgggctggacggggaggggctatgcaaagctggactgattcgggctaggtaggtttatgctgagttaaggtgagctgtactgagttgtgctacactggactgagctagctgagcttagctggtctggactggactggactggctgagcagtcagtgaacagctttctgccagggtgatgtattctgggccaccgtagcccgacgaggctgagctagctgtgctgtgcactactggacttagctgggctgggctggtcctgcccaacctgagccaccatgtgaagccctccctgttggctgtgatgcgtggtgtgcatagttggttggcctgcggggcataaacactggctcacacatcggtctcacactcgctctcactttgtggctcccacatcagcctgagttgtctgtccagggtgacttcaaggggaggggctcctatccctgctggatgccatccttgtgtggctacaggcatcccagacctccgattccctgggttcaaggctgaggtgccagtcccacagcccccacgtcctagagggaaggagagttgatcaaacctgagccggaagcctgagccggatccttctgagcaggggagcctggacacaatgttcccaagttcagggtgggctgcagtcagaacaccacccacagcaggagcaccagacctgctcccacagtgcagaagcccagggtggcctcctctgccctgttggccatgtccagccaggccatggaggctgtaggagggctcagccttgggggagcacgtcacagtgccatgagggtaggtggagaccgtcggagctctgtttgccctggactggcagggacacaggaaaacagcttttcacacctcccctttctctctttgctcccctgggccctcagt

SEQ ID NO: 57 - DNA, 106 bp, Oryctolagus cuniculus
gtgagccgcgaggcctcccgcgtgatggagaaggtccggtgtggctgggagggagcggtggggacctgggccgggccgggctgacatctcggccccatactgcagt

SEQ ID NO: 58 - DNA, 229 bp, Oryctolagus cuniculus
gtgagtgtccagtccccaggccaggacaggcgtcctcatgggtttgcagaccctgagcctcagcttcccggcacacggaagccacgggcgggagcggggtggggaagcagctggcacggcagggccaggtggggtctgagggtccccctgctgccctctgggtgaaaccaccccttcccccaaccgcacatccacccaccgcctgagaccagcttccccccaccccagc

SEQ ID NO: 59 - DNA, 88 bp, Oryctolagus cuniculus
gtaggctcagccgcctgctgccctcgcccgcctccactccctgctggcctcccccggcccaggctcaccaccttctctctgcccacag

SEQ ID NO: 60 - DNA, 1836 bp, Oryctolagus cuniculus
cccctctgggtgaccaggcgctgtgtgtgtgtgcatgcaaactaaccctgtcagtggggctgagatgttgcatttttaaaacttagaaataaaaagatccgttcaaaagatgctggtcctgagtgtgcgatgctcttgcctgctgggcccgtgactgtgctgtgcctgccctgcccccacccacctgcccacctctgagtggcctgcagaagcctctgtgctccttggctcatggtgggaagagtctgtgcacagctctcctccagctgctccagaggaacagccacgtgggcacaggcaacacatggacacacacatgcacgaagaaacatggatacacatgtatgcagatgcgggcacacacaggaggggtacgcatggatggacacatgcaaacatacagatggacagatacagacatgggtatgcacatgtgcacatgcacacacacaaagacacacacacggatacccacctgcatggacatgcccagaaacacacatggacacaaataaggacatatgcagacacatgtacagatgacacacataatatgggcaggaacacacatggccatgcagtcatggacacacatagcacattcacatggatgcatgtggaatcgtatacatgcacagacatgggcagacacaggcccacacacccacaggtgtgaacacggcctcccgtgcaggtggacacgcggacacacgcacacatgcaccagggccttggtgcctctgcagccactccctgtgccgagctggcaccaggactcctgcccaaggctctgtttgtcctgtgtctgcttggaagcttcctcagctgggctcagcctagactctgaccaaggcaatggtccccaggcccagtgcacagggctcagaatgtcgcgtcgggcttggccactgcaacagttaaaggcccaggcgtggggccaagcgtcccctcctcattcagcacccccgtggaggcagcaggccccctggcacccacctgtgagaccagagcctaggccatcagcacagagcaggcagtgtctgaacatgccaaggccaggaagccgccttaggggctccttcactggctggaagcctcaagcactggcccccacgaacctgccctgccctcagcccagcaatcagagggcagaaggcagctgtccagagaggggaggacaggagccccgtggtaaggggcctccaggctccccgggctgcctgctggaccctcccacattcacaccttttggggcctgagctccaagggctcatatatgcagagaccacaggccttaaagtgtccccatcctgctgtcaccctcaggggtccatccatgcccagagccgtgtgtcagaaagacctgggcagccagggtgtccctcacgggccctgccgaggacccagggagggggcagcttcaggcccagacctgccatcgtccttcccaagccacaggggacaggaagcccccctccctgcctctcagccctaggggccctggttgtcctcaaggagagcgagccctgggcacaagcagccaagagtcttgccgctggcgtaccctcctcgcaggtgtctgtgcactgcttctgctgtgttctgtctgtcactcggggctcccgggacaagggtcagggcagccccacccctggcttcagaccaccccaggagtcctcaggctgcaagacgggtgttctgtgcaccgccccctcctcaggagcacagcacagcctgggccaagggtggctttgatgactgggatggggtcctaggccccagcccatgtgggtgtgactgagcctgaccccctgcctccacctgtgcccttgcaga

SEQ ID NO: 61 - DNA, 127 bp, Oryctolagus cuniculus
gtagccggcctcaggcagggctggggggcagggcagagccactcgggtggatgtccgttccaggggtgcccccacgtccattcccaacacatgaacagcatctcacgccacctctgttgcctgcagg

SEQ ID NO: 62 - DNA, 28672 bp, Oryctolagus cuniculus
cccctctgggtgaccaggcgctgtgtgtgtgtgcatgcaaactaaccctgtcagtggggctgagatgttgcatttttaaaacttagaaataaaaagatccgttcaaaagatgctggtcctgagtgtgcgatgctcttgcctgctgggcccgtgactgtgctgtgcctgccctgcccccacccacctgcccacctctgagtggcctgcagaagcctctgtgctccttggctcatggtgggaagagtctgtgcacagctctcctccagctgctccagaggaacagccacgtgggcacaggcaacacatggacacacacatgcacgaagaaacatggatacacatgtatgcagatgcgggcacacacaggaggggtacgcatggatggacacatgcaaacatacagatggacagatacagacatgggtatgcacatgtgcacatgcacacacacaaagacacacacacggatacccacctgcatggacatgcccagaaacacacatggacacaaataaggacatatgcagacacatgtacagatgacacacataatatgggcaggaacacacatggccatgcagtcatggacacacatagcacattcacatggatgcatgtggaatcgtatacatgcacagacatgggcagacacaggcccacacacccacaggtgtgaacacggcctcccgtgcaggtggacacgcggacacacgcacacatgcaccagggccttggtgcctctgcagccactccctgtgccgagctggcaccaggactcctgcccaaggctctgtttgtcctgtgtctgcttggaagcttcctcagctgggctcagcctagactctgaccaaggcaatggtccccaggcccagtgcacagggctcagaatgtcgcgtcgggcttggccactgcaacagttaaaggcccaggcgtggggccaagcgtcccctcctcattcagcacccccgtggaggcagcaggccccctggcacccacctgtgagaccagagcctaggccatcagcacagagcaggcagtgtctgaacatgccaaggccaggaagccgccttaggggctccttcactggctggaagcctcaagcactggcccccacgaacctgccctgccctcagcccagcaatcagagggcagaaggcagctgtccagagaggggaggacaggagccccgtggtaaggggcctccaggctccccgggctgcctgctggaccctcccacattcacaccttttggggcctgagctccaagggctcatatatgcagagaccacaggccttaaagtgtccccatcctgctgtcaccctcaggggtccatccatgcccagagccgtgtgtcagaaagacctgggcagccagggtgtccctcacgggccctgccgaggacccagggagggggcagcttcaggcccagacctgccatcgtccttcccaagccacaggggacaggaagcccccctccctgcctctcagccctaggggccctggttgtcctcaaggagagcgagccctgggcacaagcagccaagagtcttgccgctggcgtaccctcctcgcaggtgtctgtgcactgcttctgctgtgttctgtctgtcactcggggctcccgggacaagggtcagggcagccccacccctggcttcagaccaccccaggagtcctcaggctgcaagacgggtgttctgtgcaccgccccctcctcaggagcacagcacagcctgggccaagggtggctttgatgactgggatggggtcctaggccccagcccatgtgggtgtgactgagcctgaccccctgcctccacctgtgcccttgcagaaggggaggtaggcgccgaggaggagggctttgagaacctgtggaccaccgcctccaccttcatcgtcctgttcctgctgagcctcttctacagcaccacggtcactctgttcaaggtagccggcctcaggcagggctggggggcagggcagagccactcgggtggatgtccgttccaggggtgcccccacgtccattcccaacacatgaacagcatctcacgccacctctgttgcctgcaggtgaagtgacctgagaaggatgtcggaggccaagagacaagcccgccgtggccctgctcgcgtggcctgcactctggggcctgcatcttccccatatcgccagccagctttgagctctaaagcgcaggcctcgttccagaccagcccaggaccctctgccctgtggagtgacagtgagggtgtgccccacgcgctgtgtgctgtgtgctgtgtgctgtgtgctgtgcagctgtcagtcaccctgaaataaatgcgggcggcccagctcacaaagctgctctcttgtgaggcttttgtctccgcacaaagctgtgtggatgtctgcagggaaccccaagtacaaatacgaaaatcatggtggggggcccacttaggagggggcaggcggagcccagggctgaggttcacaggggaagaggctacttgggctcaggcctcgggggccttggtgtgcccggcaggggctctgccacctccccagcgaccccgtcacctcgcagtcttgtccagaccctcgtggagcgctgagtgtgcaggaactaacttggcaggaggctcctgggtgctcgcagcatggcacagggcacgcaatccccccccagcaggcacagggcacgtacatccccccagcaggcacagggcacacacattccccccagcagcatggcacagggcacacacatccccccagcaggcacagggcacacacatccccccagcaggcacagggcacacaatcccccccagcagcaggcacagggcacgcaatcccccccagcaggcacagggcacacaatccccccccagcagcaggcacagggcacgcaatcccccccagcaggcacagggcacacaatccccccccagcagcatggcacagggcacgcaatccccccagcaggcacagggcatgcacatcctcccccccagcaggcacagggcacgcaatcccccccagcaggcacagggcatgcacatcctcccccccagcaggcacagggcacacaatcccccccagcaggcacagggcacacaattcccccccccagcagcatggcacagggcacgcaatcccccccagcaggcacagggcacacacatcccccagcaggcacagggcacacaatcccccccagcaggcacagggcacgcaatcccccccagcaggcacagggcacacaatcccccccagcaggcacagggcacacacatccccccagcaggcacagggcacacaatccccccccccagcagcaggcacagggcacgcaatcccccccagcaggcacagggcacacacatccccccagcaggcacagggcacacaattcccccccccagcagcatggcacagggcacgcaatccccccagcaggcacagggcacgcacatcctcccccccagcaggcacagggcacgcaatcccccccagcaggcacagggcacacacatccccccagcaggcacagggcacgcaatccccccaagcaggcccccggccccacggagcttcaacagcggcagtgcccctggttcccgagacaggctgagcctgcggccagcgggccggggtccactgagggctgtgcaggttcacaggtggacacccctggtactctggtggtgagagggctgagagggtgagtagccatcacttcccaaaggtctaccttgaacacctctcattggaggggacggtcaaaggataaagcagcccaaaacaatggttaggtggactcacgagacggggcggaggggcagaagtcccagctgtcccagaaagagaggccaggaaacaaggcctgaggggtggaagcggggacactggctgggttcagctcagagacaggagccccagagacagaaggtgggggctctctggatcacagcacaaaccacagaggtggctcacaggcctagggagatcctggccagcaggagggttgagagccttggaggaggcaggaggcgggaggagagaaggcagagagtgaccacgtgagcccagagccccaaggaggcacggtgggagcacatctgggaaggtgcccaccaggggtcccggagcggcaagcccagggtgcagggggcagcctggagcctgctcgggccccactgccacggtcaggctcagaggcctccagtaaacgtgccagccgagtcggggcgggttggtgagtccctgctgcaccctgcgctggccctgagcagcgagtgcgagccgcacagcaaacgccccgtgggcctggggcgctgcccgggctgtcgctcgtgtggtgggaatggagctcatggcagcaccgcccggcctgctgctgggtgggggggtgagagctcagtgagcggccagttcagccaggagcccacgcagcctgggctggggaggaagctgcaggccgtggggccgatggcctggcccgccccgcgtcagtcggcttagcccgccgagcaacacccaggacggggcagcttccaccgcagagacgtgttctcagccagctctgccaagtggggcctgggctctggatgtcagcagggagactgtcccaggcctctcttgtggcctctggtgctctcctggctgtcttggtgcccctgggcatgtagaagcaccctcgatccttgcctgacctcgtcggtgtctcctgtggacgcatccatgagggccaagttaggctggacgcctgccctcacccagtgtggactcccagagcctgaacatctgctaagccttgtgctttccaagttgggtcatgttctgaggtcctggcaggtagagttccacatgtgagcctgcagggcacacgattcctcccctagcaagcctcttcctggtgtctgtgaaggggtctggcggagttgagccccctgaaccctgggcggggcaggacagctcagagaggtggcagaagacgcttgaggaagggagttggggcggccatgtgcagcaggtgcttgagcaggacacacggtgggctgatcggggtgggcaaaggcaggtttccccagtgtctggaatagcaggaggcaggtttgcatcctggataccaggcagagggacagatcacccccagacagccccgtgtacaaggctaggtgatgggagcagcaatgatcagcgtggtgggcagggcccacagtagtgcaggtgggggcagggaaaaggccccattgagacagaaatggagcggtgccaccagagacacccagctgccctcacaccaggaccctagcaacaggagacagccgagcccaggaggaagcctcatgtgtgggaactcaccatcttcctgcctgaggccgtgggcaacccctccagggaccaggcctgctcacaggctgatgccaagcagtagagctgccaagatcaggcatcagggagaggagggtccatccagaatcacacagagggtcccgggcttccgttaacggcagccaaggatcaggggctgcaggcctggtgtaggagtcccacagcctgtccctccatgacctgggttatccctcatcctcaagggctcaaagtgagatgtggggagggtccccagggactggccagagggcattgtggtcactggaagaagaccggtggacagagccactcccaccccagccactccccagtgccctcctcaccaggactcctttcgcctccagccagggccccctcctgccccctgcccctcgccctcaggacccttgagcctctgtcttctgagatcccgtggccccagacatgttcccatcatctcagagtgggcctggtgtggctgggactggctgcacccagagctggtacaagacctgcagaagcgcgtgctgtatggtggagggctctgcaccccgagctccctgctcagtaacagaccctaaacagaccaagtctaggaaatgcctgaaaaggaattcaaaataattctcttatataaacttggtgagaaacaagagaatacagctttaaaaagttcagtgaaattaggaaaacaattcatggtctggaaagaaattcagtagaaataaataccttttttttgaagatttatttatttacttgaaagtcagttatacagagagaaaaggagaggcagagacagagagagagaaagaggccttctatctgctggtttactcctgagttggccgcaatggctggagctgcgcccatctgaagccaggagccaggagccaggagctgcttctgggtctcccacgtgggtgcagggcccaaggacttggaccatcttctaccgctttcccaggccacagcagagagctggataggaagtgaagcagctgggactcaaaccatcgcccatatgagatgcctgcactgcaggcagctgctttacctgctatgccacagggccggtgtgagaaattttggtgttaagaatcatgacacaggccggcgccgcggctcactaggctaatcctccgcctagtggcgccggcacaccgggttctagtcccggtcggggcgccggattctgtcccggtggcccctcttccaggccagctctctgctgtggcccaggagtgcagtggaggatggcccaagtgcttgagccctgcaccccatgagagaccaggataagtatctggctcctgccttcggatcagcatcagcacggtgcgccagccgcagcggccattggagggtgaaccgacggcagaggaagacctttctttctgtctctctctttctccctgtccactctgcctgtaaaaataaataaataaataaataataaaaaaaataaaaaagaaaggccacatgttataaaaaaaatcacgacacagacatacataattcttaacatacacaattcttaacaaataccaaaaatctaaaaagccatgaattgtcattgttttttagtcattccaataactttgcaacttcagatttggaggacagtcttccttatgaggatactaactaccaatatcttcaaatgttgctgttacataaacacaccaatccacaatctcaaatttctagtctttcacagcacattagcaaaatcattaggaaaactgggcaactgcagggtctcagtccacccgaacgaggatggactgggtccaagcgaaggtaagtgcgacgctcgcccgctccccagcctcctgatcccagagacaatcagacgcagcgggagtcgagtcaagcaggaactcatttattactgcgcagtaagcctgttttaaagctaaaaaccacaaagctataggggaggagaagagaaaccaaccaatcgttttaaacgttacctatcgtgcgctaggtttccatagagtccacgcactgacgtcatctcgcctggtgcctgcgcccagtcaagtttcattgtaaacaactcggactccgcccgtctagcttcctctcggcgccatcttcgtgtccagcactgcggagatggtccttgagcagctggggcaggagcttctcctccagaggaaggcagctgggcgggcagggccagatgacctcgtgctgcagccccgtgcggatctggtagcggccgctgagcagctggctctgcgacggcgtgcacagcggctgcgtgtagtagttgtccagcagcacgtggccggcggccagcagcaggaggagcagcagcagcagcagtagcggcggctgccccagcccatcctgccccgccagcccacgcctgcggcccctgctgccccgcttatagacgcgggcccggcacagcaggtgcagcaggggcccgggcagcgggtgctgggggcttctctggccgctgctcaaagggcgccagatccaggccagggcacagtgttgggagtctgtccagacccttgagtgtgcgcaggcccatgaggacaacagcgcaatgcaggcgcaccacggccgcaccaccctccccagggccagtcccgctacctccccgcgagccacgcgccacagccaccctcatgccccgcaggcaaccacaaccagaggcattacaaagtacacatggcttgttctgtaggaaacagttctatggaacaacgtgggaggagtaattgcagatattcaaggcagattaaatgcacaattgtgacttgaaattgccattttgtattgtgaggtataaaattcaccacgaactacagagtgtgttaatctgacacacaagacaatcaaagtctccacaagtcaatattcactgttttccggctgtaccaaaaaaaaaaaaaaaaaaaaaaaagcaaataatttaatctcttaaaaaatcatttacatttgaaaaatgagattaggtgggtgttcctccttcttaaaagtgtttctagaaatcttcagttaattttcaacacttaagaataactgtgtgataattacagaattaaatcagtcatattaagtagaacagacaaaaaaaaatactatgagggataatgtattaagttgtccattagcagtcagggctatgctgatcaagtcaccatttctcatagtgtccatttcacttcaggaggtttcctttttggtgttcagtcagttgtcaccgatcagggagaacatatggtatttgtccctttgggactggcttacttcactcagcatgatgtgttccagattcctccattttgttgcaaatgactggatttcgttgtttcttactgcggtatagtattctaaagaatacatatcccataatttctttatccagtctaccattgatgggcatttaggttggttccaggtcttggctattgtgaattgtgctgcaataaacattagggtgcagaccgcttttttctttatcaatttaaactcctttgggtaaattccaaggagtgggatggctgggtcgaacggtagggttatattcaggtttctgaggaatctccagactgatttccatagtggtttgaccagtttgcattcccaccaacagtgggttagtgtccctttttccccacatcctcaccagcatctgttgttggtagatttctgtatgtgagccattctaaccggggtgaggtgaaacctcattgtgcttttgatttgcatttccctgattgctagtgaccttgaacattttttcatgtgcctgttggccatttggatttcctcttttgaaaaatgtctattgaagtccttggcccatctcttaagtgggttgttggttttgtttttgtggagtttcttgatctctttgtagattctggttattaaccctttatctgttgcatagtttgcaaatattttttcccattctgttggttgtctcttcactctcctgtttcttttgcagtacagaaacttctcaatttgatgcaatcccaatagttgattttggctttgactgtctgtgcctcccgggtcttttccagaaattctttgcctgtgccaatatcttgaagagtttctccaatgttctctaataacttaatggtgtcaggacgtagatttaggtctttaatccacgttgagtggatttttgtgtaaggtataaggtaggggtcttgcttcatgcttctgcatgtggaaatccagttttcccagcaccatttattgaatagactgtccttgctccaggaattagttttagatccttgatcaaatataagttggctgtagatgtttggattgatttctggtgtttcaattctgttccattggtctatccatctgtttctgtaccagtaccatgctgttttgattacaactgccctgtagtatgtcctgaagtctggtattgtgatgcctccggctttgtttttgttgtacatgattgctttagctattcgaggtctcttgtgcctccatatgaatttcagcatcattttttctagatctgcgaagaatgtctttgctatcttgattgggattgcattgaatctataaattgcttttgggagaatggacattttgatgatgttgattcttccaatccatgagcatggaagatttttccattttttggtatcctcttctatttctttctttaaggttttgtaattttcatcgtagagatctttaacgtccttggttaagtttattccaaggtatttgattgtttttgtagctattgtgaatgggattgatcttagcagttctttctcaatcatggcattgcttgtgtatacaaaggctgttgatttttgtgcattgattttatatcctgccactttgccaaactcctctatgagttccaatagtctcttagtagagttctttggatcctctaagtacagaatcatatcgtctgcaaagagggatagtttgacttcttccttcttgatttgtattcctttgatttctttttcttgtctgatggctctggctaaaacttccagaactatgttaaatagcagtggtgagagtgggcatccctgtctggtaccagatctcagtggaaatgcttccaacttttccccattcaataggatgctggctgtgggttttttataaattgctttgattatattgaggaatgttccttctatacccaatttgcttagagttttcatcatgaaagggtgttgaattttatcaaatgctttctctgcatcaattgagataaccatatggtttttcttcggcacaatatttgcaaactatgcaacagataaagggttaataaccaagtcagaaattgaatcaataataaaggtcttcccaaccagaccaagtgggatttatccctggtatgcagggatgattcaacatttgcaaatcattcagtatgatacatcacattaacaaattgaagaacaaaaaccatacggttatctcaatagatgtagagaaggcatttgataaaatacaacaccctttcatgatgaagattctaagcaaattgggtatagaaggaacattcctcaacacaatctgggcaatttatgacaagcccatggccagcaccatagtgaatgggggaaagctggaagcattcccactgagatccagtaccagacagagatgcccactctcatcattgctattcaacataatactggaagttttagccagaacccttagtcaagaaaaagaaatcaaagggatacaaattgggaaggaggaagtaaaaccatccctgtttgcagacaacatgattctttatttaggagatccaaagaactgtactaagaaactattgaaactcattgaagagtttggtaatgtagtaggatataaaatcaatacacaaaaatcggcagcctttgtatacagatacaatgtcatggctgagaaagaacttctaagatcaatcccgttcacaatagctattaaaaaaaatcaaataccttggaataaacttgaccaaggatgtcaaaaatcactatgatgacaattataaaacattaagaaagaaagaagatacaaaaaatggaaaaatcttctgtgttcatggattggaagaatcaataacatcaggggctggagctgaggcacagtgggttaacaccctggcctgaagcactggcatcccataggggcgccggttctagtaccagctgctccacttccgatccagctctctgctatggcttgggaaagcaatagaagatggcccaagtccttcggcccctgcacccatgtgggaatcccagaagaagttcctggttcttggcttcagataggcacagctctgaccattgcaaccaattggggagtgaaccatcatatggaagacctctctctctctctctctctctctctctctctctttctctgcctctcctctctctgtgtaactctgactttcaaattaattaattagataataaataaataaataaaaataatcaatataatcaaaatgtccattcgtgccggcgccacagctcaataagctaatcctccgcctagcggtaccagtacaccgggttctagtcccggtcagggcgccggattctgtcccgattgcccctcttccaggccagctctctgctgtggccagggagtgcagtggaggatggcccaagtgcttgggccctgcacaccatgggagaccaggagaagcacctggctcctgccttcagatcagcgtggtgcgccagccattggagggtgaaccaacagcaaaggaagacctttctgtctgtctctctctctctcactgtccactctgtcaaaaaaaatgtccattcttacaaaagcaatttgcaaattcaatgtgatacccatcaaaataccaaagacattcttctcagatctggaaaaatgatgctaaaattcatatgcaggcacaggagaccttgaatagctaaagcaatcttgtatgacaaaaacaaagccagaggcatcacaataccagatttcaagacgtgctagagggcagttataatcaaaacagctgggtactggtacagaaacagatggatagaccaatggaacagaatagaaacaccaaaaatcaattcaaacatctacaaccaacttatatttgatcaaggagctaaaaccaattcctggagcaaggacagtctattcaacaaatggtgctgggaaaactggatttccacatgcagaagtatgaaacaagacccctaccttacaccttacacaaaaatccacccaacatggattaaaggtctaaatctatgacccaacaccatcaaattattaggtaacatcagagaaaccctgcaagatataggcacaggcaaagatttcttggaaaataacccagaggcacagacagtcaaagccagaattaacaattgggattacatcaaattgagaagtttctgtactgcaaaagatagagtcaagaaagggaataggcaaccaacagaatgagagaaaatatttgcaaactatgcaactaataaaggattaataaccagaatctacaaagagatcaagaaattccacaacatcaaaacaaacaacccacttaagagatgggccaaggacctcaatagacatttttcaaaagaggaaatccaaatggccaacagacacatgaaaaaatgttcaggatcattagccatcagggaaatgcaaatcaaaaccaaaatgaggtttcacctcaccccagttagaatggctcacattcagaaatctaccaacaacagatgctggtgaggatgtggggaaaaaagtgtcctaatccactgttggtgggaatgcaaactggtaaagccactatggaagtcagtttggagattcctcagaaacctgaatatagccctaccatacaacccagccatcccactccttgaaatttacccaagggaaattaaattggcaaataaaagagctatctgcacctcaaagtttactgcagctcaattcacaatagctaaaacatggaatcaacctaaatgcccatcaaccaaagactggataaagaaattatgggatatgtactctatggaatactacaaagtggtaaaaaaaatcaatgaaatctggtcatttgcaacaaaatggaggaatctggaaaacatcatgctgagtgcaataaaccagacccaaagggacaaatatcgtatgttctccctgatctgtgacaactaactgagcacctaaaaggaaacctgtattagtgaaactgacactacaagaagcaatgacttgatcagcccctgtcctatcgaggaacagcttactattttattctttttagtattttcctgttctacttaataccatgagttgaactctttacttaacacagaattattcttaggtgtttaaatttaactgaaaagtgatccctgttaaatataagagtgggaataagagaggaaggagatgtacagttcagcacatgctcactcgaacttacccctaatggtagagctagaaacatgccatgggactccaaatcccattaagttggcatgtaccaatgccatcttactagttaaagtgatcagtttaagttcataattgatcataaagataggattaagtgtcaaagagattacataaacaagaccagtgtctgctaataacaatataattaaattaaaaaggagtgaacactccaacatgggaagagggatacacagcagactcatagactggcagagccctaaatagcactctggcctcagaatcagcccttaagccattcagatccagttaaaaagcccatgagagtttctcaggtgtggaaagccaggacactgtggcaaaaaaaaaatgacctaaatgaaagatctctgtgagtgagatcccagcggaaagaacagaccatcaaggaaggaggtacctctctctgaagggaggagagaacttccactttgattatggccttgtctaaatgaggtcagagtttgtgaactcaagaggcttccatagccttggcagcttatgacaagagcctcgggtgattactgacgtcataaataagagtgtcaattgttaaatcaacaacaggagtcactgtgcacttactccccatgtaggatctctgcccttaatgtgttgtactatatgaattaatagtaaaactagtattcaaacagtactttatactttgtgtgtctgtgtggggaactctttacttagtatatactatgttgatctgctgtatataaagataattaaaaatgaatcttaggccagcgccgcagctcactaggctaatcctccgcctgcagcgccagcacaccaggttctagtcccggtcggggcgccggttctgtcccagttgctcctcttccagtccagctctctgctgtggcccgcaagtgcagtggagaatggcccaagtccttgggccctgcacccgagtcagagaccaggagaaacacctggctcctggatttggatcagcatggtgtgccagccacagtgtgccggccacagcggccattaggggatgaaccaatggaaaaaggaagacctttctctctccctctctccctctctccctctctccctctctccctctctccctctctccctctctctcccccctactctccactctgcctgtcaaaaaaaaaaaatgaatcttaatgaagaatgggatgggagagggactaggagatgggatggtttgtgggtgggagagtggttatatggggaaaaaccgctataatccaaaagttgtactttcgaaatttatattttttaaataaaagttttaaaaaatgggtgctggttctagtcctggctgctcctcttcccatccagctctctgctatggcctgggatagcaacgaaagttgcccaagtccttgggcccctgcacccacgtgggagacctggaggaagctcctggctcctggcttcagattggggcagctctggtgattgtggccactggggagtgaaccagcggatagaagacctcactctctgtctctacctctctctgtaactctgtctttcgaataaataaaataaatctttataactaaaaaataaagtgtttctagagctactgaaaaacttgcatttacaaaatgaacaaaaatattcctctggactgcacaagaagggagacagggacctctgaccacatgtggtgtgcgatgtttgtgactggcttctttctcagctgcttcaccagaggtgcacgcatttcagtgggtgggagggtgtctctgcgctctgcagaccaatcctggttctcagtgagtcactgcgcctttgctgctttcttctctttcatctgcactgtgtttgtctgaagacttagccttccccattgcattttggggcttcggttttccccatagaacatcaatttattaaatttattagagaatgtttctgtttgtaaacatatgcagaattcccatgcatgacggtggggagagcacctgcaggccatgtcgccccaagagccttcaaagctgggttgtttgatcactgttgctcctcctgccacagagctcccaggagaaacaaatgggacccaattgggagccccctgcagaaatagatatcactttaaaatgaaccaaaagaaatcgtagagctgaaaatttcaacaaatgaaactaaaaatgcaactgagtgtttcaacagattagatcaagcaggaaaaaatatttctgaatttaaaaagatagatctttggaaacagcacagtgtgaagaggagataagaattataagaatgaggaagcctacggagcctatgcattaccatcaacaaaactcacattattggagcggcagagggagaaaggatgcactaaagcacagaagacgtaactcaccagttaacagccaaaaatgtgctgtgtcctgggggagatttgtgcttccagataccagcagctcaaaatcacaaatgggcccaacctagagaggtcctgtctggccacactatggtcagattgtcaagtcaaaggcaatgagaattccaaatgcagcaagacaaaggctttgactgaggtccttttcactatcaattttcttagttttgattcccaagggatcagctcagcttataaacactggggatcctttccatcccaggcccagcccttatggttaggtggaaagaccccgggacaggagaatggaagagaccacaccctctgctaaccaagggtcgaggatatgcttgtgtctttccagagaatgcgggacagcccatttgggtaccagccagaaacatcaagcctgcaactgacagccaaccagaaccagctgaacaagactgagagtccgccttgttagcagatgcacctaccctaacatcctaccctgagaaactgaccatagcaacatctgttacagttttacaccccactagctctggtcagccacccaaacggcccacagcctgagtgtggtcacgcccttcctgattaccgttgttcctcattcctacccctatctgtgcaagcactcctgtggtctcccattttgagtgctggttagtcaacgataggtaagatcccatgggggacaacctaagacaggcatagccatgtacagagaccacatggaaacggggtcaacaatggtatgcccaagaatcatgcctcctgttgctcaaaaataaacaaaaagggggaaatgtggtggaatgagaaggccatgccaagatggctgctggcaacagaaactgcctggcaacaggctgtgattggatggtttcagaaacttcctggcaacagcctgtgattggttagggcatagaccaccccttgaccagattggctgcctcagctatataagctgctgtaccaactaaaataaacaagtttacaggctgcttgcctcactcctgctttcacccaactcccggggtctgtgtggtgactctgcacctcttgcccccaccacactcttcctctcagaacgaatccacagcaacagtgtcctgggggagatttgtgcatccagataccagaagcccaaaatcacaaatgggtccaaactagagaggtcctatctgggcatattgtggtcagattgtcaggtcaaagacaatgagaattccaaacgcagcaagacaaaggtgtcaggtcccaggtaagggagtcttcataagtctcaggagatttctcagcagaaaccttgcaggctggaggacaatggatgataaactcgagatgctgaatgcaaaaaaaacaaaaacaaaaacaaaaaaaacttccctctaagactgctgtacccagctaaactatgatggagaaaaaagcccttccctgacatgcagaagctaggggaattcaccacagtggaactaccttatgagaatacgtgagggagtgctgcaaatggaagcaaagggcaataatctgtaaagcagccagtgttgtggcagctactgcttgcaacaccagtgtcccatttccaagtgttggctcaagtcccagcagctctgcttccaatcagcttcctactaatgcatctgggaaaccaggagatgaccctagtaattgagccacagtcacccatgtgggagacccacatggagtgccaggctcctggcttctgcctggcccagccctggccattatagccattttggggagtgaaccagcatatggaagatctctgtgtctctccctctctgtgtcactctttcaaataagtaaataaataaataaataaatctttttaaaaagttgaagtctaaaaatcactaacagacgcaagcgtataatggctcagatacccccatactgcactggtgctatgcagagctttcacacctgtagaatgaaggtgcaagtccatcagttgttaaagaatgtacaagatagaaatataaaagtgaaagcaacagaagtctaaattactgggttaggataaaagtctgctctttctgatgtgtgtcaggatcctgaagtgtctcttccaagaactggaacaggaaatgaaatgtgactttacccatacaatcctgaacacaagacacaatcaagccaatggtttccaaggggcaagcggcccagtcacagcaaaggtaggcgggtcagcaacagaggtcacggcaacatcgtctggggatgctccaggtgttgtgtttgtcggcttgctggagaatgcaggaatgataacggctgcttggtaggaaagtgctctgaggaagtcggccagagtccagcagaggaaggctggcagacgtccccccagcacattgctcccgcctggtgctcttgctgggcacaggcagccctgggggcactgtgagtggaggtggaggacacacaccttgcttttggctcctctgacttctttttgcttcctaattttacaaatagctttaaagggcacctatttttctttggttaagaatgcaatgaccgtgctgacctggttgtctccccagggccctcaggtggttacgggtggatgcaatggttggcaccatcacttacaatgatgtctcttttttcttaagatttatttatttacttgaaaggcagagttacagagatgcagaggtggggggggggcttccatctgctggttcactccccagatggccacaatggcaggagctgtgccaatccaaagtcagagccaagggtttcttctgggtctcccacatggatgcagggccttgggctattgctgtggattcattctgagaggaatgtggtgggagcaagaggtgcggagtcaccacacagacactgggggtggggtgaaagcggttcagaggcgagtagcctgcaaactcatttatttcagttggtacagcagcttatatagctgaggcagccaattcagtcaaggggcagtttataccctaaccaatcacagcctgttgccaggcagtttctgttgccagcggccatcttggcatggccttctcattccacatttccccctttttgtttatttttgagcaacaggaggcatgattcttggccacaccattgttgaccccatttccatgtggtctctgtatgtggttgtgcctgtcttaggctgtcccccatgggatcttacctgtcgttgactaaccagtgctcaaaacgggagaccagaggagtgcttgctcagatgggggtaggaatgaggaacaatggtaatcaggaagggcgtgactgcacgcgggctgtgggccgtttgggtggctgaccagagctagtggggtataaagcagtagtggatgtggctatgggcagttcctcagggtaggatgatagggcagcagcttgacaatcagtagcaggtgcatctgctaacaaggtggactctcagtcttgttcagctggttctggttggctgtcagttgcaggcttgatgtttctggctggtacccaaatgggctgtcccgcattctctggaaagactcaagcatatctttggtccttagttagcagaagcctttttacgggagttggaatccaagtcctgaattctgtgtccacttcaagattatctgcaaggatgtgggtgggttgaggtctagtggcttccctgagagcctggggtgcctggcgactgccacaaacgtggagatccttgctgggtgcagatgcgatgacctcacatgggttattgcatcgaggtcatctaagttcatcccacggatatgtggggggtggctgactaggcattgctgcgttgtctgctgtcatgtcattttcactgtcagagctctctctccctaagtcatcaactgttacttgtgaggcagagacctggagtgacaggcttttatcactcacagattcattatatttggtaatttgtgcaggcttctgagaggagggtatctttctcatgtttgagcacttaagagtggcacaccatgccaactctagccaaagtaaagacatgcacagcactgctgccataacaaagcaaattcctagcacctcagcagcttatggcattctgcaggagttccctaccttaaacaaacagatagtgatgtatcagatcatacgtatgtcctgtgcttagtgggggacttccttgattcgttaggtcaaggccatatgctcacacggtgtctctggagtgtcacctctctcgagtgagggaagatgacttggttccgaattctgggatgatcagtcccttatgtgaatttgcagggcgaaccgaaagtaaaaggaggagcttctgggcggtgtgtgcctaacctggggtcacttagaccgaggacaaggacaaggaaaggggagtaggaggggggttctttgctcaccctcacagaaacgaacagtacacagaacaccgagggacctacttgtcaaaatcaaggagagacctcgccaagtctgacatgctgtctctgtctcagttacattggtgtcagatgttgctgtggattcattctgagaggagcgcggtgggggcaagaggcacagagtcaccacacagaccccaggagttgggtgaaagtggtccagaggcgagcagcctacagactcatttatttctgttcgtacagcagcttatatagccaaggcagccaatctagtcaaggagcggtttatgccctaaccaatcacagcctgtggccaggcaggctccattgtcatgtggtttctgaagccatccaatcacaactgttgccaggcaggctccattgccagcagccatcttggcatggccttctcattccaccacattgggccatcttctactgctttcccaggccacaacagttctgaagtggagcagccgggactcaaactggcacccacatgggacagcagcactgcaggcagtggctttacccactgtgccacactgccagcccccatttcttttaagacccttttcctcaggtctttcacacacacatgggctaatttcttcctaccttttatttttctttcattttttaagatttatttatttgaaaggcagagttacagagagacagagagatcttccatctgctggttcactcccaaatggccacaacatccagagcagggctggatgaacccagaagccaggagtttcctctggtcccaagcactgggcactcctctgctgcttccccaggtgcatcagcagggagctggatgagaagtggagcagtcagaacccatgtctatatggaactttaccgctatgccacagcactggccctctaacttcctacctgacaaaggcaggagcagcagcaagcagtccctgccgcccagcctacctggtttctctcctcagtgcccctgctggtcacaccccatccaaagtgagaaagacagagcccagcagggcagaaccctgcagtgaactcagtgagtgcctgccagtgcccagccaggctctgctcaggggaggctggtcctgtccagaacaagggtagcactgcccacactatgaggcacctttgctagccaagtcccaagacccctggggcagggtctgctcctggctggaagcaggtgggccacggctcccagacttctggccattgcacttctgctgctctcttcacagcaagtccgagtccacactcatgccctccacctcccctgcagggcctgtgggtccaggaggaggccgcctgcacccgcttggtgctgggacatgacctgcaggaaggtcacttgtcctgggaggggccggagcgcccctcaagcaggcggtggaggaccggccgcttaagcagctcatccacactggggctaaagttgccgaaggcactgaaagcaaggtgagaggccgctacccagggccgagctcacgcccgcctccaggaccagccagggtggctcccgtgccgcttcagggaccccaggggcccacacacacccacctgaaggcagcccagggccgagctcacgcccacctcaggaccagccagggtggttcccatgccgcttcagggaccccaggggcccgcccacacccacctgaaggcagcccagggccctgcacacgcccaccccaggactgtgcccacctccagatcactcaaggccagtgcacaaacaccgcaggacctcccaggactgcccagagccacacccatgcccacctcaactccgcccagagccgtgcggggctgcacccacacccactttagggctgcccagagccaggcccttgttcatgtcagggccgtgtccacaatgcctcaaggaccccagggtgccaccgtgtccaccttaggtccacccagggccaccccaccgcctacctcagagtcgccaagggacaagcccacctaaaggccgtgctgggctctgcgcaaaatggtctcagggccgtcccgggctgcttctgtgtgctcacacctcagagacccccccaaggttcctcccatgcccacctcagccccgcccagggccgctctcaagcccacccgcccacgaccacgcctgtgcccacctgagggccgcccagagccccgcccaccccaactcccccagggccccacctctgcccacctcatggccgctcaggacagcgttggcaccaaggatgagaccccggggtcccacccgcgctcacttcaaggccatccggggcctcccatgaccactctaactcaagtgctgtgacctcagggacgctcctgagcccacctcagccccatcgcaaggccgccaaaggccacaaacgcccatctcagggcctctcagggacacgcccactccaaagctgcccagggcgcgcctgcgcccacctcagggatgcccatggcccagtgcacaatgacctctaacctttgggccgccccaggctgcgtctgcatctgcccccagctctgagctcccagagtctcgccggcgccccattcaaatccacccaggaccccacccagggctgcaacccacccacctcagggccgcccagcgatgcattgcccgcctcagtgcagccgtacctgtgcgcgggattactcgggtcactttccacaagggcctgaggggcagggcccctgggctcccgcatccatggacagcactgcggcgcgagcctgccaggttcgcagtcacagcccatggcagatctcgggaacactgctccagcctggagcggcatgagcacccggtctcggtgagccctcagccggccgcccagcaagaggcctcacggaaactgctggaggtcagcgggagcctgggcactgctgggggccctgggtaggctcaagggctggtaaggcgctgaccccagaggcggcttccctccactggggcctgaggagggcccagtgccttctccactggcaaccctgagcaagctccccttggccctgggctcaggcccacactggtgctgtcgggtggcaggtgggtgttggcctttgtttgtcactgggtttgcttgggtcctgtcaggattctcttttaaaaaatattgattttgccggcgccacggctcactaggctgatcctccgccttgcggcaccggcacactgggttctagtcccagtcgggatgccggattctgtcccagttgcccctcttccaggccagctctctgctgtggcccgggagtgcagtgcaggatggcccaagtgcttgggccctgcaccccagaaagctcctggctcctggcttcggatcagcacagggcaccagccgtagcagccatttggggggtgaaccaacggaagaaagacctttctctctctctctctctctctccccccctcttactgtctaactctgcccatcaaaaaaatttattttatttatttggaagagagctagagagctagaggaagagagagagaggtgtcttccatccactggttcgctccccaattggccacaacatccagaactgagccaatccgaagagccaagagccagaagcttcttccgggtctcccacgtgtgtgcagggccccagcacttgggtcatcttccactgccttcccaggccacagcagagagctggaagggaggtggagcagccgggactcagacggcacccgtataggatgctcgcactgcaggtggcggctttaccagctatgccacagcgccggcccctagtcagcgttctctcctagggtgaatgtgggtgtggcctcgacacagctgccctctcaggggtgtctgacagtctagaagcacggcaggaagctctggaagtcagaaggtctccgaagagccccagaaatgaggacctgagctctcgttctgccctggcttggcctgggccctgttcctgcatggcccctctgtgcctggctgcatagtcaggaggcaatgtgtgggctaacccagcatgatcctggaattcagaccccaggccgaccagccccagccagaggaggaagcttcagcggccagggagcagggggctggccctgtgggtcaccactgcctgggacaccagcacccacgtgagcaccagtcaagtcccagcagctctgcttctcagtaatatgccttggaagcagcagacggcttgggccctgccacagtgtgggaaacctgcctgtagttgcaggctcctggcgtcagcctggctcagccctggccatggagccattgggggaatgaaccaatgggtgaaagatctgtgtgtgtgtgtgtgtgtgtgtgtgtctccctctatgtctgtcactctgcctttcaaataaatttttaaaaatcccttttaaaagctttctgaaagctatgccagcttctctcagcccaaaggcctcaggcccagacctgccggcagccccaggcccagcatgggcttctgtccaaggtgaccctgaggggtggcctcacaaatcctcaggggacctccctgcagggagcccctagactggcagccactcttcacacctccaacgcacctgttctctcccagagagtctgcagcccaggcctccgcccctggctaccccactgaccatcagggctgggacgttccctcccccaccctccctttcaggcctcatccacactggccatcagctgtggtgtcctccctctctgggtctgtctgtcccctgctgttgacatggcctcctggcctgttcctccctggcccgtcgggtagacagaaaggcatcccctgcccaagggctccatgctggccgtctccctggtctctcttctcccatgcccagccgtccagccgcccccaggcacagatggtctggagatcaccggtggcctgggaaacccagctggacaggcctgggtgagattggaggctgttccaccccaggcaccagggcatcaagtctcagtactatggggcatatgtatgtgacaacctgcagtgaccaagtgccagacacaacacgagagcacctggctgcccctgtggtcaagagccctggcacccttattttattttattttttaaaggtttttttatttacttgaaaggcagagttacagagaggcagaggcagggtgggggtagggtcttccatcctcacaacagctggagctgagccaattgaaagccaggagccaggagcttcttccaggtctcccacgcaggtgcagggggcgtaaggacttgggccatcttctgctgctttcccaggccataacagagagctggatcggaagaggagcagtcgggactagaactggcgcccatatgggatgctggtgccgcaggcagaggattaacctactgtgccacagtgccagcccccctgggacctttagacctggactttctccccccatctttggggaaccaggagcacctacatcctgggctgctgtgaggattaaatgagttggtgctggaggtgcccagcccctgtatgtagaatggggccaggtgtacaggactctgcaggcctgcaggtgtttcctactgcccagtgcacctcacccttttgcgtgcatggggtcgcagggtgaatcctgacatctaggaggcagtcctgaccccagagtggagctgaagcctccagagccttgacccggcccagccacacctccctacaggggccctggcagagccagtgtctgttcacctccttgaaccaggtactctggggataggagggctgcagcagccacaggaggccaggcccagccaagccagcctcctaccagccctgactccaagctgcaaggccctggcctgttcccagggcccttctggggatgcccagggaccctggcagtgagtgggggcaaggcctcctccaggagccaagctatggtgctcactcagaaacacagctgcaggccctgcctgctctcagaccctgctctggccaggcagaggacagctggaactgcacccctggctgaagtagtctcagcccctctggagtgaacctgctgcctgtaagcccccacctgcccactgctgggatcacagcctgacgccccacagcccaccctggccccaccaaccctcccgattcagctgtgctttgctttctccacaggaccccaggtggtcttctcactgccccgctctgggcttcctcccacggcctctgtgggtcacaccctaacctcttggatctagagtcggccaccatgagcccctctccccaaacaaggagacattgcaatgctgtcagtgccggcactggaggccatgaccaccatgcacgaatgaccccacgaagcctgcccctcctcacggtgctcctggcttcatgggatggccacagctgccctcgtcccacagaaagaagtcgcaccctactgtcacccttgcagccgagggacccgccaatcctgctcctccctcactgagcccagcccatccctccccaggatatcacaaggccccgctggcccctccacggccactttcactccatcctttgctcagcggccaaggtcatcttttgaagtgtacatttgagctcttccagttaaagatggtgtacaagacggtggcaggcagtcgctctaggagaaaggggagtaccagagaaacaattattcaccacaccttcgttcacgcatactcagagaatccagcagaggcaaattgctgcaccagaggagaccggtggctctcccgtcctgggcccaggtggacaggcaatgggctcagggaagaagagatcagacaggatgctgatgtccgggtgggcggccgtgaagagcccccagcaggttccccacaggccccgggccaagtgcacagcggctggaagcagagctggcaagcagtgagcgatccagccttgcacagaccccacagcttgctggaggaagggcgcagacgtcagaaccagaggacaggggtgctgcccccagcccccgccaagctcacacaggattggagtggagagatcagccctgtgggaacagaaacagcagcgagaattaggcccacagggacgggacccagatgttggaattaagaacaatgcagactgtcacctccagttcagactcctccaggacccgccacaccggtgagggagccgggctgctctccagagccgttgtcctccacgctgcgtctcctgcctaaggagctcccaccccactgtctgcccagtggctgcctcctgtgcccccgggggaggtgtgaccccttacttccacctgcctggagcccatggtgttgagccgcctgaccgcaccctgggtcacttgccattgcattccaagcgtttccagttgtctgcataaaggactagcagcttctacatttccaactcaccatggaagagtctcagaatcagttattacgaaagctaaaggggcagaaacggacacaccagttcattttttactgggctcctctggctgctacaaagctgtgctcacacacgtctgtccttactcccacggcccaggatgccgtccctggacctgcccctgccagaccccacgtgcagcagctcggagcacgcagcgcagtctccgtccacttgggtgaatcccagggagtcctggtgttgtggtgctcccttctagacgtcctacctgcctggggctttccgccatgggcctgggtgtgctctctgtgcaagtgcagcccaaactgttctgtgtatacgtttggttgtgacacacccttgcttcaagtcctccagtggctccccattcctatcaagaacctaccaccaggcatggcctggacacagcccagactaccctccctgctgttaggaaactggcacagttttatctatggcgcgatctacaccctgatttacatcccaagctctagcccccgccgccattgctggaagccaggtggccacatggcccaacctctgtggtcaagctccaccccatcctaatgggattcgctgctcctgcttccctgcccgccctccagcaaagcttgagtattctatagtgtcacctaaatag

SEQ ID NO: 63 - DNA, 50484 bp, Oryctolagus cuniculus
cccctctgggtgaccaggcgctgtgtgtgtgtgcatgcaaactaaccctgtcagtggggctgagatgttgcatttttaaaacttagaaataaaaagatccgttcaaaagatgctggtcctgagtgtgcgatgctcttgcctgctgggcccgtgactgtgctgtgcctgccctgcccccacccacctgcccacctctgagtggcctgcagaagcctctgtgctccttggctcatggtgggaagagtctgtgcacagctctcctccagctgctccagaggaacagccacgtgggcacaggcaacacatggacacacacatgcacgaagaaacatggatacacatgtatgcagatgcgggcacacacaggaggggtacgcatggatggacacatgcaaacatacagatggacagatacagacatgggtatgcacatgtgcacatgcacacacacaaagacacacacacggatacccacctgcatggacatgcccagaaacacacatggacacaaataaggacatatgcagacacatgtacagatgacacacataatatgggcaggaacacacatggccatgcagtcatggacacacatagcacattcacatggatgcatgtggaatcgtatacatgcacagacatgggcagacacaggcccacacacccacaggtgtgaacacggcctcccgtgcaggtggacacgcggacacacgcacacatgcaccagggccttggtgcctctgcagccactccctgtgccgagctggcaccaggactcctgcccaaggctctgtttgtcctgtgtctgcttggaagcttcctcagctgggctcagcctagactctgaccaaggcaatggtccccaggcccagtgcacagggctcagaatgtcgcgtcgggcttggccactgcaacagttaaaggcccaggcgtggggccaagcgtcccctcctcattcagcacccccgtggaggcagcaggccccctggcacccacctgtgagaccagagcctaggccatcagcacagagcaggcagtgtctgaacatgccaaggccaggaagccgccttaggggctccttcactggctggaagcctcaagcactggcccccacgaacctgccctgccctcagcccagcaatcagagggcagaaggcagctgtccagagaggggaggacaggagccccgtggtaaggggcctccaggctccccgggctgcctgctggaccctcccacattcacaccttttggggcctgagctccaagggctcatatatgcagagaccacaggccttaaagtgtccccatcctgctgtcaccctcaggggtccatccatgcccagagccgtgtgtcagaaagacctgggcagccagggtgtccctcacgggccctgccgaggacccagggagggggcagcttcaggcccagacctgccatcgtccttcccaagccacaggggacaggaagcccccctccctgcctctcagccctaggggccctggttgtcctcaaggagagcgagccctgggcacaagcagccaagagtcttgccgctggcgtaccctcctcgcaggtgtctgtgcactgcttctgctgtgttctgtctgtcactcggggctcccgggacaagggtcagggcagccccacccctggcttcagaccaccccaggagtcctcaggctgcaagacgggtgttctgtgcaccgccccctcctcaggagcacagcacagcctgggccaagggtggctttgatgactgggatggggtcctaggccccagcccatgtgggtgtgactgagcctgaccccctgcctccacctgtgcccttgcagaaggggaggtaggcgccgaggaggagggctttgagaacctgtggaccaccgcctccaccttcatcgtcctgttcctgctgagcctcttctacagcaccacggtcactctgttcaaggtagccggcctcaggcagggctggggggcagggcagagccactcgggtggatgtccgttccaggggtgcccccacgtccattcccaacacatgaacagcatctcacgccacctctgttgcctgcaggtgaagtgacctgagaaggatgtcggaggccaagagacaagcccgccgtggccctgctcgcgtggcctgcactctggggcctgcatcttccccatatcgccagccagctttgagctctaaagcgcaggcctcgttccagaccagcccaggaccctctgccctgtggagtgacagtgagggtgtgccccacgcgctgtgtgctgtgtgctgtgtgctgtgtgctgtgcagctgtcagtcaccctgaaataaatgcgggcggcccagctcacaaagctgctctcttgtgaggcttttgtctccgcacaaagctgtgtggatgtctgcagggaaccccaagtacaaatacgaaaatcatggtggggggcccacttaggagggggcaggcggagcccagggctgaggttcacaggggaagaggctacttgggctcaggcctcgggggccttggtgtgcccggcaggggctctgccacctccccagcgaccccgtcacctcgcagtcttgtccagaccctcgtggagcgctgagtgtgcaggaactaacttggcaggaggctcctgggtgctcgcagcatggcacagggcacgcaatccccccccagcaggcacagggcacgtacatccccccagcaggcacagggcacacacattccccccagcagcatggcacagggcacacacatccccccagcaggcacagggcacacacatccccccagcaggcacagggcacacaatcccccccagcagcaggcacagggcacgcaatcccccccagcaggcacagggcacacaatccccccccagcagcaggcacagggcacgcaatcccccccagcaggcacagggcacacaatccccccccagcagcatggcacagggcacgcaatccccccagcaggcacagggcatgcacatcctcccccccagcaggcacagggcacgcaatcccccccagcaggcacagggcatgcacatcctcccccccagcaggcacagggcacacaatcccccccagcaggcacagggcacacaattcccccccccagcagcatggcacagggcacgcaatcccccccagcaggcacagggcacacacatcccccagcaggcacagggcacacaatcccccccagcaggcacagggcacgcaatcccccccagcaggcacagggcacacaatcccccccagcaggcacagggcacacacatccccccagcaggcacagggcacacaatccccccccccagcagcaggcacagggcacgcaatcccccccagcaggcacagggcacacacatccccccagcaggcacagggcacacaattcccccccccagcagcatggcacagggcacgcaatccccccagcaggcacagggcacgcacatcctcccccccagcaggcacagggcacgcaatcccccccagcaggcacagggcacacacatccccccagcaggcacagggcacgcaatccccccaagcaggcccccggccccacggagcttcaacagcggcagtgcccctggttcccgagacaggctgagcctgcggccagcgggccggggtccactgagggctgtgcaggttcacaggtggacacccctggtactctggtggtgagagggctgagagggtgagtagccatcacttcccaaaggtctaccttgaacacctctcattggaggggacggtcaaaggataaagcagcccaaaacaatggttaggtggactcacgagacggggcggaggggcagaagtcccagctgtcccagaaagagaggccaggaaacaaggcctgaggggtggaagcggggacactggctgggttcagctcagagacaggagccccagagacagaaggtgggggctctctggatcacagcacaaaccacagaggtggctcacaggcctagggagatcctggccagcaggagggttgagagccttggaggaggcaggaggcgggaggagagaaggcagagagtgaccacgtgagcccagagccccaaggaggcacggtgggagcacatctgggaaggtgcccaccaggggtcccggagcggcaagcccagggtgcagggggcagcctggagcctgctcgggccccactgccacggtcaggctcagaggcctccagtaaacgtgccagccgagtcggggcgggttggtgagtccctgctgcaccctgcgctggccctgagcagcgagtgcgagccgcacagcaaacgccccgtgggcctggggcgctgcccgggctgtcgctcgtgtggtgggaatggagctcatggcagcaccgcccggcctgctgctgggtgggggggtgagagctcagtgagcggccagttcagccaggagcccacgcagcctgggctggggaggaagctgcaggccgtggggccgatggcctggcccgccccgcgtcagtcggcttagcccgccgagcaacacccaggacggggcagcttccaccgcagagacgtgttctcagccagctctgccaagtggggcctgggctctggatgtcagcagggagactgtcccaggcctctcttgtggcctctggtgctctcctggctgtcttggtgcccctgggcatgtagaagcaccctcgatccttgcctgacctcgtcggtgtctcctgtggacgcatccatgagggccaagttaggctggacgcctgccctcacccagtgtggactcccagagcctgaacatctgctaagccttgtgctttccaagttgggtcatgttctgaggtcctggcaggtagagttccacatgtgagcctgcagggcacacgattcctcccctagcaagcctcttcctggtgtctgtgaaggggtctggcggagttgagccccctgaaccctgggcggggcaggacagctcagagaggtggcagaagacgcttgaggaagggagttggggcggccatgtgcagcaggtgcttgagcaggacacacggtgggctgatcggggtgggcaaaggcaggtttccccagtgtctggaatagcaggaggcaggtttgcatcctggataccaggcagagggacagatcacccccagacagccccgtgtacaaggctaggtgatgggagcagcaatgatcagcgtggtgggcagggcccacagtagtgcaggtgggggcagggaaaaggccccattgagacagaaatggagcggtgccaccagagacacccagctgccctcacaccaggaccctagcaacaggagacagccgagcccaggaggaagcctcatgtgtgggaactcaccatcttcctgcctgaggccgtgggcaacccctccagggaccaggcctgctcacaggctgatgccaagcagtagagctgccaagatcaggcatcagggagaggagggtccatccagaatcacacagagggtcccgggcttccgttaacggcagccaaggatcaggggctgcaggcctggtgtaggagtcccacagcctgtccctccatgacctgggttatccctcatcctcaagggctcaaagtgagatgtggggagggtccccagggactggccagagggcattgtggtcactggaagaagaccggtggacagagccactcccaccccagccactccccagtgccctcctcaccaggactcctttcgcctccagccagggccccctcctgccccctgcccctcgccctcaggacccttgagcctctgtcttctgagatcccgtggccccagacatgttcccatcatctcagagtgggcctggtgtggctgggactggctgcacccagagctggtacaagacctgcagaagcgcgtgctgtatggtggagggctctgcaccccgagctccctgctcagtaacagaccctaaacagaccaagtctaggaaatgcctgaaaaggaattcaaaataattctcttatataaacttggtgagaaacaagagaatacagctttaaaaagttcagtgaaattaggaaaacaattcatggtctggaaagaaattcagtagaaataaataccttttttttgaagatttatttatttacttgaaagtcagttatacagagagaaaaggagaggcagagacagagagagagaaagaggccttctatctgctggtttactcctgagttggccgcaatggctggagctgcgcccatctgaagccaggagccaggagccaggagctgcttctgggtctcccacgtgggtgcagggcccaaggacttggaccatcttctaccgctttcccaggccacagcagagagctggataggaagtgaagcagctgggactcaaaccatcgcccatatgagatgcctgcactgcaggcagctgctttacctgctatgccacagggccggtgtgagaaattttggtgttaagaatcatgacacaggccggcgccgcggctcactaggctaatcctccgcctagtggcgccggcacaccgggttctagtcccggtcggggcgccggattctgtcccggtggcccctcttccaggccagctctctgctgtggcccaggagtgcagtggaggatggcccaagtgcttgagccctgcaccccatgagagaccaggataagtatctggctcctgccttcggatcagcatcagcacggtgcgccagccgcagcggccattggagggtgaaccgacggcagaggaagacctttctttctgtctctctctttctccctgtccactctgcctgtaaaaataaataaataaataaataataaaaaaaataaaaaagaaaggccacatgttataaaaaaaatcacgacacagacatacataattcttaacatacacaattcttaacaaataccaaaaatctaaaaagccatgaattgtcattgttttttagtcattccaataactttgcaacttcagatttggaggacagtcttccttatgaggatactaactaccaatatcttcaaatgttgctgttacataaacacaccaatccacaatctcaaatttctagtctttcacagcacattagcaaaatcattaggaaaactgggcaactgcagggtctcagtccacccgaacgaggatggactgggtccaagcgaaggtaagtgcgacgctcgcccgctccccagcctcctgatcccagagacaatcagacgcagcgggagtcgagtcaagcaggaactcatttattactgcgcagtaagcctgttttaaagctaaaaaccacaaagctataggggaggagaagagaaaccaaccaatcgttttaaacgttacctatcgtgcgctaggtttccatagagtccacgcactgacgtcatctcgcctggtgcctgcgcccagtcaagtttcattgtaaacaactcggactccgcccgtctagcttcctctcggcgccatcttcgtgtccagcactgcggagatggtccttgagcagctggggcaggagcttctcctccagaggaaggcagctgggcgggcagggccagatgacctcgtgctgcagccccgtgcggatctggtagcggccgctgagcagctggctctgcgacggcgtgcacagcggctgcgtgtagtagttgtccagcagcacgtggccggcggccagcagcaggaggagcagcagcagcagcagtagcggcggctgccccagcccatcctgccccgccagcccacgcctgcggcccctgctgccccgcttatagacgcgggcccggcacagcaggtgcagcaggggcccgggcagcgggtgctgggggcttctctggccgctgctcaaagggcgccagatccaggccagggcacagtgttgggagtctgtccagacccttgagtgtgcgcaggcccatgaggacaacagcgcaatgcaggcgcaccacggccgcaccaccctccccagggccagtcccgctacctccccgcgagccacgcgccacagccaccctcatgccccgcaggcaaccacaaccagaggcattacaaagtacacatggcttgttctgtaggaaacagttctatggaacaacgtgggaggagtaattgcagatattcaaggcagattaaatgcacaattgtgacttgaaattgccattttgtattgtgaggtataaaattcaccacgaactacagagtgtgttaatctgacacacaagacaatcaaagtctccacaagtcaatattcactgttttccggctgtaccaaaaaaaaaaaaaaaaaaaaaaaagcaaataatttaatctcttaaaaaatcatttacatttgaaaaatgagattaggtgggtgttcctccttcttaaaagtgtttctagaaatcttcagttaattttcaacacttaagaataactgtgtgataattacagaattaaatcagtcatattaagtagaacagacaaaaaaaaatactatgagggataatgtattaagttgtccattagcagtcagggctatgctgatcaagtcaccatttctcatagtgtccatttcacttcaggaggtttcctttttggtgttcagtcagttgtcaccgatcagggagaacatatggtatttgtccctttgggactggcttacttcactcagcatgatgtgttccagattcctccattttgttgcaaatgactggatttcgttgtttcttactgcggtatagtattctaaagaatacatatcccataatttctttatccagtctaccattgatgggcatttaggttggttccaggtcttggctattgtgaattgtgctgcaataaacattagggtgcagaccgcttttttctttatcaatttaaactcctttgggtaaattccaaggagtgggatggctgggtcgaacggtagggttatattcaggtttctgaggaatctccagactgatttccatagtggtttgaccagtttgcattcccaccaacagtgggttagtgtccctttttccccacatcctcaccagcatctgttgttggtagatttctgtatgtgagccattctaaccggggtgaggtgaaacctcattgtgcttttgatttgcatttccctgattgctagtgaccttgaacattttttcatgtgcctgttggccatttggatttcctcttttgaaaaatgtctattgaagtccttggcccatctcttaagtgggttgttggttttgtttttgtggagtttcttgatctctttgtagattctggttattaaccctttatctgttgcatagtttgcaaatattttttcccattctgttggttgtctcttcactctcctgtttcttttgcagtacagaaacttctcaatttgatgcaatcccaatagttgattttggctttgactgtctgtgcctcccgggtcttttccagaaattctttgcctgtgccaatatcttgaagagtttctccaatgttctctaataacttaatggtgtcaggacgtagatttaggtctttaatccacgttgagtggatttttgtgtaaggtataaggtaggggtcttgcttcatgcttctgcatgtggaaatccagttttcccagcaccatttattgaatagactgtccttgctccaggaattagttttagatccttgatcaaatataagttggctgtagatgtttggattgatttctggtgtttcaattctgttccattggtctatccatctgtttctgtaccagtaccatgctgttttgattacaactgccctgtagtatgtcctgaagtctggtattgtgatgcctccggctttgtttttgttgtacatgattgctttagctattcgaggtctcttgtgcctccatatgaatttcagcatcattttttctagatctgcgaagaatgtctttgctatcttgattgggattgcattgaatctataaattgcttttgggagaatggacattttgatgatgttgattcttccaatccatgagcatggaagatttttccattttttggtatcctcttctatttctttctttaaggttttgtaattttcatcgtagagatctttaacgtccttggttaagtttattccaaggtatttgattgtttttgtagctattgtgaatgggattgatcttagcagttctttctcaatcatggcattgcttgtgtatacaaaggctgttgatttttgtgcattgattttatatcctgccactttgccaaactcctctatgagttccaatagtctcttagtagagttctttggatcctctaagtacagaatcatatcgtctgcaaagagggatagtttgacttcttccttcttgatttgtattcctttgatttctttttcttgtctgatggctctggctaaaacttccagaactatgttaaatagcagtggtgagagtgggcatccctgtctggtaccagatctcagtggaaatgcttccaacttttccccattcaataggatgctggctgtgggttttttataaattgctttgattatattgaggaatgttccttctatacccaatttgcttagagttttcatcatgaaagggtgttgaattttatcaaatgctttctctgcatcaattgagataaccatatggtttttcttcggcacaatatttgcaaactatgcaacagataaagggttaataaccaagtcagaaattgaatcaataataaaggtcttcccaaccagaccaagtgggatttatccctggtatgcagggatgattcaacatttgcaaatcattcagtatgatacatcacattaacaaattgaagaacaaaaaccatacggttatctcaatagatgtagagaaggcatttgataaaatacaacaccctttcatgatgaagattctaagcaaattgggtatagaaggaacattcctcaacacaatctgggcaatttatgacaagcccatggccagcaccatagtgaatgggggaaagctggaagcattcccactgagatccagtaccagacagagatgcccactctcatcattgctattcaacataatactggaagttttagccagaacccttagtcaagaaaaagaaatcaaagggatacaaattgggaaggaggaagtaaaaccatccctgtttgcagacaacatgattctttatttaggagatccaaagaactgtactaagaaactattgaaactcattgaagagtttggtaatgtagtaggatataaaatcaatacacaaaaatcggcagcctttgtatacagatacaatgtcatggctgagaaagaacttctaagatcaatcccgttcacaatagctattaaaaaaaatcaaataccttggaataaacttgaccaaggatgtcaaaaatcactatgatgacaattataaaacattaagaaagaaagaagatacaaaaaatggaaaaatcttctgtgttcatggattggaagaatcaataacatcaggggctggagctgaggcacagtgggttaacaccctggcctgaagcactggcatcccataggggcgccggttctagtaccagctgctccacttccgatccagctctctgctatggcttgggaaagcaatagaagatggcccaagtccttcggcccctgcacccatgtgggaatcccagaagaagttcctggttcttggcttcagataggcacagctctgaccattgcaaccaattggggagtgaaccatcatatggaagacctctctctctctctctctctctctctctctctctttctctgcctctcctctctctgtgtaactctgactttcaaattaattaattagataataaataaataaataaaaataatcaatataatcaaaatgtccattcgtgccggcgccacagctcaataagctaatcctccgcctagcggtaccagtacaccgggttctagtcccggtcagggcgccggattctgtcccgattgcccctcttccaggccagctctctgctgtggccagggagtgcagtggaggatggcccaagtgcttgggccctgcacaccatgggagaccaggagaagcacctggctcctgccttcagatcagcgtggtgcgccagccattggagggtgaaccaacagcaaaggaagacctttctgtctgtctctctctctctcactgtccactctgtcaaaaaaaatgtccattcttacaaaagcaatttgcaaattcaatgtgatacccatcaaaataccaaagacattcttctcagatctggaaaaatgatgctaaaattcatatgcaggcacaggagaccttgaatagctaaagcaatcttgtatgacaaaaacaaagccagaggcatcacaataccagatttcaagacgtgctagagggcagttataatcaaaacagctgggtactggtacagaaacagatggatagaccaatggaacagaatagaaacaccaaaaatcaattcaaacatctacaaccaacttatatttgatcaaggagctaaaaccaattcctggagcaaggacagtctattcaacaaatggtgctgggaaaactggatttccacatgcagaagtatgaaacaagacccctaccttacaccttacacaaaaatccacccaacatggattaaaggtctaaatctatgacccaacaccatcaaattattaggtaacatcagagaaaccctgcaagatataggcacaggcaaagatttcttggaaaataacccagaggcacagacagtcaaagccagaattaacaattgggattacatcaaattgagaagtttctgtactgcaaaagatagagtcaagaaagggaataggcaaccaacagaatgagagaaaatatttgcaaactatgcaactaataaaggattaataaccagaatctacaaagagatcaagaaattccacaacatcaaaacaaacaacccacttaagagatgggccaaggacctcaatagacatttttcaaaagaggaaatccaaatggccaacagacacatgaaaaaatgttcaggatcattagccatcagggaaatgcaaatcaaaaccaaaatgaggtttcacctcaccccagttagaatggctcacattcagaaatctaccaacaacagatgctggtgaggatgtggggaaaaaagtgtcctaatccactgttggtgggaatgcaaactggtaaagccactatggaagtcagtttggagattcctcagaaacctgaatatagccctaccatacaacccagccatcccactccttgaaatttacccaagggaaattaaattggcaaataaaagagctatctgcacctcaaagtttactgcagctcaattcacaatagctaaaacatggaatcaacctaaatgcccatcaaccaaagactggataaagaaattatgggatatgtactctatggaatactacaaagtggtaaaaaaaatcaatgaaatctggtcatttgcaacaaaatggaggaatctggaaaacatcatgctgagtgcaataaaccagacccaaagggacaaatatcgtatgttctccctgatctgtgacaactaactgagcacctaaaaggaaacctgtattagtgaaactgacactacaagaagcaatgacttgatcagcccctgtcctatcgaggaacagcttactattttattctttttagtattttcctgttctacttaataccatgagttgaactctttacttaacacagaattattcttaggtgtttaaatttaactgaaaagtgatccctgttaaatataagagtgggaataagagaggaaggagatgtacagttcagcacatgctcactcgaacttacccctaatggtagagctagaaacatgccatgggactccaaatcccattaagttggcatgtaccaatgccatcttactagttaaagtgatcagtttaagttcataattgatcataaagataggattaagtgtcaaagagattacataaacaagaccagtgtctgctaataacaatataattaaattaaaaaggagtgaacactccaacatgggaagagggatacacagcagactcatagactggcagagccctaaatagcactctggcctcagaatcagcccttaagccattcagatccagttaaaaagcccatgagagtttctcaggtgtggaaagccaggacactgtggcaaaaaaaaaatgacctaaatgaaagatctctgtgagtgagatcccagcggaaagaacagaccatcaaggaaggaggtacctctctctgaagggaggagagaacttccactttgattatggccttgtctaaatgaggtcagagtttgtgaactcaagaggcttccatagccttggcagcttatgacaagagcctcgggtgattactgacgtcataaataagagtgtcaattgttaaatcaacaacaggagtcactgtgcacttactccccatgtaggatctctgcccttaatgtgttgtactatatgaattaatagtaaaactagtattcaaacagtactttatactttgtgtgtctgtgtggggaactctttacttagtatatactatgttgatctgctgtatataaagataattaaaaatgaatcttaggccagcgccgcagctcactaggctaatcctccgcctgcagcgccagcacaccaggttctagtcccggtcggggcgccggttctgtcccagttgctcctcttccagtccagctctctgctgtggcccgcaagtgcagtggagaatggcccaagtccttgggccctgcacccgagtcagagaccaggagaaacacctggctcctggatttggatcagcatggtgtgccagccacagtgtgccggccacagcggccattaggggatgaaccaatggaaaaaggaagacctttctctctccctctctccctctctccctctctccctctctccctctctccctctctccctctctctcccccctactctccactctgcctgtcaaaaaaaaaaaatgaatcttaatgaagaatgggatgggagagggactaggagatgggatggtttgtgggtgggagagtggttatatggggaaaaaccgctataatccaaaagttgtactttcgaaatttatattttttaaataaaagttttaaaaaatgggtgctggttctagtcctggctgctcctcttcccatccagctctctgctatggcctgggatagcaacgaaagttgcccaagtccttgggcccctgcacccacgtgggagacctggaggaagctcctggctcctggcttcagattggggcagctctggtgattgtggccactggggagtgaaccagcggatagaagacctcactctctgtctctacctctctctgtaactctgtctttcgaataaataaaataaatctttataactaaaaaataaagtgtttctagagctactgaaaaacttgcatttacaaaatgaacaaaaatattcctctggactgcacaagaagggagacagggacctctgaccacatgtggtgtgcgatgtttgtgactggcttctttctcagctgcttcaccagaggtgcacgcatttcagtgggtgggagggtgtctctgcgctctgcagaccaatcctggttctcagtgagtcactgcgcctttgctgctttcttctctttcatctgcactgtgtttgtctgaagacttagccttccccattgcattttggggcttcggttttccccatagaacatcaatttattaaatttattagagaatgtttctgtttgtaaacatatgcagaattcccatgcatgacggtggggagagcacctgcaggccatgtcgccccaagagccttcaaagctgggttgtttgatcactgttgctcctcctgccacagagctcccaggagaaacaaatgggacccaattgggagccccctgcagaaatagatatcactttaaaatgaaccaaaagaaatcgtagagctgaaaatttcaacaaatgaaactaaaaatgcaactgagtgtttcaacagattagatcaagcaggaaaaaatatttctgaatttaaaaagatagatctttggaaacagcacagtgtgaagaggagataagaattataagaatgaggaagcctacggagcctatgcattaccatcaacaaaactcacattattggagcggcagagggagaaaggatgcactaaagcacagaagacgtaactcaccagttaacagccaaaaatgtgctgtgtcctgggggagatttgtgcttccagataccagcagctcaaaatcacaaatgggcccaacctagagaggtcctgtctggccacactatggtcagattgtcaagtcaaaggcaatgagaattccaaatgcagcaagacaaaggctttgactgaggtccttttcactatcaattttcttagttttgattcccaagggatcagctcagcttataaacactggggatcctttccatcccaggcccagcccttatggttaggtggaaagaccccgggacaggagaatggaagagaccacaccctctgctaaccaagggtcgaggatatgcttgtgtctttccagagaatgcgggacagcccatttgggtaccagccagaaacatcaagcctgcaactgacagccaaccagaaccagctgaacaagactgagagtccgccttgttagcagatgcacctaccctaacatcctaccctgagaaactgaccatagcaacatctgttacagttttacaccccactagctctggtcagccacccaaacggcccacagcctgagtgtggtcacgcccttcctgattaccgttgttcctcattcctacccctatctgtgcaagcactcctgtggtctcccattttgagtgctggttagtcaacgataggtaagatcccatgggggacaacctaagacaggcatagccatgtacagagaccacatggaaacggggtcaacaatggtatgcccaagaatcatgcctcctgttgctcaaaaataaacaaaaagggggaaatgtggtggaatgagaaggccatgccaagatggctgctggcaacagaaactgcctggcaacaggctgtgattggatggtttcagaaacttcctggcaacagcctgtgattggttagggcatagaccaccccttgaccagattggctgcctcagctatataagctgctgtaccaactaaaataaacaagtttacaggctgcttgcctcactcctgctttcacccaactcccggggtctgtgtggtgactctgcacctcttgcccccaccacactcttcctctcagaacgaatccacagcaacagtgtcctgggggagatttgtgcatccagataccagaagcccaaaatcacaaatgggtccaaactagagaggtcctatctgggcatattgtggtcagattgtcaggtcaaagacaatgagaattccaaacgcagcaagacaaaggtgtcaggtcccaggtaagggagtcttcataagtctcaggagatttctcagcagaaaccttgcaggctggaggacaatggatgataaactcgagatgctgaatgcaaaaaaaacaaaaacaaaaacaaaaaaaacttccctctaagactgctgtacccagctaaactatgatggagaaaaaagcccttccctgacatgcagaagctaggggaattcaccacagtggaactaccttatgagaatacgtgagggagtgctgcaaatggaagcaaagggcaataatctgtaaagcagccagtgttgtggcagctactgcttgcaacaccagtgtcccatttccaagtgttggctcaagtcccagcagctctgcttccaatcagcttcctactaatgcatctgggaaaccaggagatgaccctagtaattgagccacagtcacccatgtgggagacccacatggagtgccaggctcctggcttctgcctggcccagccctggccattatagccattttggggagtgaaccagcatatggaagatctctgtgtctctccctctctgtgtcactctttcaaataagtaaataaataaataaataaatctttttaaaaagttgaagtctaaaaatcactaacagacgcaagcgtataatggctcagatacccccatactgcactggtgctatgcagagctttcacacctgtagaatgaaggtgcaagtccatcagttgttaaagaatgtacaagatagaaatataaaagtgaaagcaacagaagtctaaattactgggttaggataaaagtctgctctttctgatgtgtgtcaggatcctgaagtgtctcttccaagaactggaacaggaaatgaaatgtgactttacccatacaatcctgaacacaagacacaatcaagccaatggtttccaaggggcaagcggcccagtcacagcaaaggtaggcgggtcagcaacagaggtcacggcaacatcgtctggggatgctccaggtgttgtgtttgtcggcttgctggagaatgcaggaatgataacggctgcttggtaggaaagtgctctgaggaagtcggccagagtccagcagaggaaggctggcagacgtccccccagcacattgctcccgcctggtgctcttgctgggcacaggcagccctgggggcactgtgagtggaggtggaggacacacaccttgcttttggctcctctgacttctttttgcttcctaattttacaaatagctttaaagggcacctatttttctttggttaagaatgcaatgaccgtgctgacctggttgtctccccagggccctcaggtggttacgggtggatgcaatggttggcaccatcacttacaatgatgtctcttttttcttaagatttatttatttacttgaaaggcagagttacagagatgcagaggtggggggggggcttccatctgctggttcactccccagatggccacaatggcaggagctgtgccaatccaaagtcagagccaagggtttcttctgggtctcccacatggatgcagggccttgggctattgctgtggattcattctgagaggaatgtggtgggagcaagaggtgcggagtcaccacacagacactgggggtggggtgaaagcggttcagaggcgagtagcctgcaaactcatttatttcagttggtacagcagcttatatagctgaggcagccaattcagtcaaggggcagtttataccctaaccaatcacagcctgttgccaggcagtttctgttgccagcggccatcttggcatggccttctcattccacatttccccctttttgtttatttttgagcaacaggaggcatgattcttggccacaccattgttgaccccatttccatgtggtctctgtatgtggttgtgcctgtcttaggctgtcccccatgggatcttacctgtcgttgactaaccagtgctcaaaacgggagaccagaggagtgcttgctcagatgggggtaggaatgaggaacaatggtaatcaggaagggcgtgactgcacgcgggctgtgggccgtttgggtggctgaccagagctagtggggtataaagcagtagtggatgtggctatgggcagttcctcagggtaggatgatagggcagcagcttgacaatcagtagcaggtgcatctgctaacaaggtggactctcagtcttgttcagctggttctggttggctgtcagttgcaggcttgatgtttctggctggtacccaaatgggctgtcccgcattctctggaaagactcaagcatatctttggtccttagttagcagaagcctttttacgggagttggaatccaagtcctgaattctgtgtccacttcaagattatctgcaaggatgtgggtgggttgaggtctagtggcttccctgagagcctggggtgcctggcgactgccacaaacgtggagatccttgctgggtgcagatgcgatgacctcacatgggttattgcatcgaggtcatctaagttcatcccacggatatgtggggggtggctgactaggcattgctgcgttgtctgctgtcatgtcattttcactgtcagagctctctctccctaagtcatcaactgttacttgtgaggcagagacctggagtgacaggcttttatcactcacagattcattatatttggtaatttgtgcaggcttctgagaggagggtatctttctcatgtttgagcacttaagagtggcacaccatgccaactctagccaaagtaaagacatgcacagcactgctgccataacaaagcaaattcctagcacctcagcagcttatggcattctgcaggagttccctaccttaaacaaacagatagtgatgtatcagatcatacgtatgtcctgtgcttagtgggggacttccttgattcgttaggtcaaggccatatgctcacacggtgtctctggagtgtcacctctctcgagtgagggaagatgacttggttccgaattctgggatgatcagtcccttatgtgaatttgcagggcgaaccgaaagtaaaaggaggagcttctgggcggtgtgtgcctaacctggggtcacttagaccgaggacaaggacaaggaaaggggagtaggaggggggttctttgctcaccctcacagaaacgaacagtacacagaacaccgagggacctacttgtcaaaatcaaggagagacctcgccaagtctgacatgctgtctctgtctcagttacattggtgtcagatgttgctgtggattcattctgagaggagcgcggtgggggcaagaggcacagagtcaccacacagaccccaggagttgggtgaaagtggtccagaggcgagcagcctacagactcatttatttctgttcgtacagcagcttatatagccaaggcagccaatctagtcaaggagcggtttatgccctaaccaatcacagcctgtggccaggcaggctccattgtcatgtggtttctgaagccatccaatcacaactgttgccaggcaggctccattgccagcagccatcttggcatggccttctcattccaccacattgggccatcttctactgctttcccaggccacaacagttctgaagtggagcagccgggactcaaactggcacccacatgggacagcagcactgcaggcagtggctttacccactgtgccacactgccagcccccatttcttttaagacccttttcctcaggtctttcacacacacatgggctaatttcttcctaccttttatttttctttcattttttaagatttatttatttgaaaggcagagttacagagagacagagagatcttccatctgctggttcactcccaaatggccacaacatccagagcagggctggatgaacccagaagccaggagtttcctctggtcccaagcactgggccatcctctgctgcttccccaggtgcatcagcagggagctggatgagaagtggagcagtcagaacccatgtctatatggaactttaccgctatgccacagcactggccctctaacttcctacctgacaaaggcaggagcagcagcaagcagtccctgccgcccagcctacctggtttctctcctcagtgcccctgctggtcacaccccatccaaagtgagaaagacagagcccagcagggcagaaccctgcagtgaactcagtgagtgcctgccagtgcccagccaggctctgctcaggggaggctggtcctgtccagaacaagggtagcactgcccacactatgaggcacctttgctagccaagtcccaagacccctggggcagggtctgctcctggctggaagcaggtgggccacggctcccagacttctggccattgcacttctgctgctctcttcacagcaagtccgagtccacactcatgccctccacctcccctgcagggcctgtgggtccaggaggaggccgcctgcacccgcttggtgctgggacatgacctgcaggaaggtcacttgtcctgggaggggccggagcgcccctcaagcaggcggtggaggaccggccgcttaagcagctcatccacactggggctaaagttgccgaaggcactgaaagcaaggtgagaggccgctacccagggccgagctcacgcccgcctccaggaccagccagggtggctcccgtgccgcttcagggaccccaggggcccacacacacccacctgaaggcagcccagggccgagctcacgcccacctcaggaccagccagggtggttcccatgccgcttcagggaccccaggggcccgcccacacccacctgaaggcagcccagggccctgcacacgcccaccccaggactgtgcccacctccagatcactcaaggccagtgcacaaacaccgcaggacctcccaggactgcccagagccacacccatgcccacctcaactccgcccagagccgtgcggggctgcacccacacccactttagggctgcccagagccaggcccttgttcatgtcagggccgtgtccacaatgcctcaaggaccccagggtgccaccgtgtccaccttaggtccacccagggccaccccaccgcctacctcagagtcgccaagggacaagcccacctaaaggccgtgctgggctctgcgcaaaatggtctcagggccgtcccgggctgcttctgtgtgctcacacctcagagacccccccaaggttcctcccatgcccacctcagccccgcccagggccgctctcaagcccacccgcccacgaccacgcctgtgcccacctgagggccgcccagagccccgcccaccccaactcccccagggccccacctctgcccacctcatggccgctcaggacagcgttggcaccaaggatgagaccccggggtcccacccgcgctcacttcaaggccatccggggcctcccatgaccactctaactcaagtgctgtgacctcagggacgctcctgagcccacctcagccccatcgcaaggccgccaaaggccacaaacgcccatctcagggcctctcagggacacgcccactccaaagctgcccagggcgcgcctgcgcccacctcagggatgcccatggcccagtgcacaatgacctctaacctttgggccgccccaggctgcgtctgcatctgcccccagctctgagctcccagagtctcgccggcgccccattcaaatccacccaggaccccacccagggctgcaacccacccacctcagggccgcccagcgatgcattgcccgcctcagtgcagccgtacctgtgcgcgggattactcgggtcactttccacaagggcctgaggggcagggcccctgggctcccgcatccatggacagcactgcggcgcgagcctgccaggttcgcagtcacagcccatggcagatctcgggaacactgctccagcctggagcggcatgagcacccggtctcggtgagccctcagccggccgcccagcaagaggcctcacggaaactgctggaggtcagcgggagcctgggcactgctgggggccctgggtaggctcaagggctggtaaggcgctgaccccagaggcggcttccctccactggggcctgaggagggcccagtgccttctccactggcaaccctgagcaagctccccttggccctgggctcaggcccacactggtgctgtcgggtggcaggtgggtgttggcctttgtttgtcactgggtttgcttgggtcctgtcaggattctcttttaaaaaatattgattttgccggcgccacggctcactaggctgatcctccgccttgcggcaccggcacactgggttctagtcccagtcgggatgccggattctgtcccagttgcccctcttccaggccagctctctgctgtggcccgggagtgcagtgcaggatggcccaagtgcttgggccctgcaccccagaaagctcctggctcctggcttcggatcagcacagggcaccagccgtagcagccatttggggggtgaaccaacggaagaaagacctttctctctctctctctctctctccccccctcttactgtctaactctgcccatcaaaaaaatttattttatttatttggaagagagctagagagctagaggaagagagagagaggtgtcttccatccactggttcgctccccaattggccacaacatccagaactgagccaatccgaagagccaagagccagaagcttcttccgggtctcccacgtgtgtgcagggccccagcacttgggtcatcttccactgccttcccaggccacagcagagagctggaagggaggtggagcagccgggactcagacggcacccgtataggatgctcgcactgcaggtggcggctttaccagctatgccacagcgccggcccctagtcagcgttctctcctagggtgaatgtgggtgtggcctcgacacagctgccctctcaggggtgtctgacagtctagaagcacggcaggaagctctggaagtcagaaggtctccgaagagccccagaaatgaggacctgagctctcgttctgccctggcttggcctgggccctgttcctgcatggcccctctgtgcctggctgcatagtcaggaggcaatgtgtgggctaacccagcatgatcctggaattcagaccccaggccgaccagccccagccagaggaggaagcttcagcggccagggagcagggggctggccctgtgggtcaccactgcctgggacaccagcacccacgtgagcaccagtcaagtcccagcagctctgcttctcagtaatatgccttggaagcagcagacggcttgggccctgccacagtgtgggaaacctgcctgtagttgcaggctcctggcgtcagcctggctcagccctggccatggagccattgggggaatgaaccaatgggtgaaagatctgtgtgtgtgtgtgtgtgtgtgtgtgtctccctctatgtctgtcactctgcctttcaaataaatttttaaaaatcccttttaaaagctttctgaaagctatgccagcttctctcagcccaaaggcctcaggcccagacctgccggcagccccaggcccagcatgggcttctgtccaaggtgaccctgaggggtggcctcacaaatcctcaggggacctccctgcagggagcccctagactggcagccactcttcacacctccaacgcacctgttctctcccagagagtctgcagcccaggcctccgcccctggctaccccactgaccatcagggctgggacgttccctcccccaccctccctttcaggcctcatccacactggccatcagctgtggtgtcctccctctctgggtctgtctgtcccctgctgttgacatggcctcctggcctgttcctccctggcccgtcgggtagacagaaaggcatcccctgcccaagggctccatgctggccgtctccctggtctctcttctcccatgcccagccgtccagccgcccccaggcacagatggtctggagatcaccggtggcctgggaaacccagctggacaggcctgggtgagattggaggctgttccaccccaggcaccagggcatcaagtctcagtactatggggcatatgtatgtgacaacctgcagtgaccaagtgccagacacaacacgagagcacctggctgcccctgtggtcaagagccctggcacccttattttattttattttttaaaggtttttttatttacttgaaaggcagagttacagagaggcagaggcagggtgggggtagggtcttccatcctcacaacagctggagctgagccaattgaaagccaggagccaggagcttcttccaggtctcccacgcaggtgcagggggcgtaaggacttgggccatcttctgctgctttcccaggccataacagagagctggatcggaagaggagcagtcgggactagaactggcgcccatatgggatgctggtgccgcaggcagaggattaacctactgtgccacagtgccagcccccctgggacctttagacctggactttctccccccatctttggggaaccaggagcacctacatcctgggctgctgtgaggattaaatgagttggtgctggaggtgcccagcccctgtatgtagaatggggccaggtgtacaggactctgcaggcctgcaggtgtttcctactgcccagtgcacctcacccttttgcgtgcatggggtcgcagggtgaatcctgacatctaggaggcagtcctgaccccagagtggagctgaagcctccagagccttgacccggcccagccacacctccctacaggggccctggcagagccagtgtctgttcacctccttgaaccaggtactctggggataggagggctgcagcagccacaggaggccaggcccagccaagccagcctcctaccagccctgactccaagctgcaaggccctggcctgttcccagggcccttctggggatgcccagggaccctggcagtgagtgggggcaaggcctcctccaggagccaagctatggtgctcactcagaaacacagctgcaggccctgcctgctctcagaccctgctctggccaggcagaggacagctggaactgcacccctggctgaagtagtctcagcccctctggagtgaacctgctgcctgtaagcccccacctgcccactgctgggatcacagcctgacgccccacagcccaccctggccccaccaaccctcccgattcagctgtgctttgctttctccacaggaccccaggtggtcttctcactgccccgctctgggcttcctcccacggcctctgtgggtcacaccctaacctcttggatctagagtcggccaccatgagcccctctccccaaacaaggagacattgcaatgctgtcagtgccggcactggaggccatgaccaccatgcacgaatgaccccacgaagcctgcccctcctcacggtgctcctggcttcatgggatggccacagctgccctcgtcccacagaaagaagtcgcaccctactgtcacccttgcagccgagggacccgccaatcctgctcctccctcactgagcccagcccatccctccccaggatatcacaaggccccgctggcccctccacggccactttcactccatcctttgctcagcggccaaggtcatcttttgaagtgtacatttgagctcttccagttaaagatggtgtacaagacggtggcaggcagtcgctctaggagaaaggggagtaccagagaaacaattattcaccacaccttcgttcacgcatactcagagaatccagcagaggcaaattgctgcaccagaggagaccggtggctctcccgtcctgggcccaggtggacaggcaatgggctcagggaagaagagatcagacaggatgctgatgtccgggtgggcggccgtgaagagcccccagcaggttccccacaggccccgggccaagtgcacagcggctggaagcagagctggcaagcagtgagcgatccagccttgcacagaccccacagcttgctggaggaagggcgcagacgtcagaaccagaggacaggggtgctgcccccagcccccgccaagctcacacaggattggagtggagagatcagccctgtgggaacagaaacagcagcgagaattaggcccacagggacgggacccagatgttggaattaagaacaatgcagactgtcacctccagttcagactcctccaggacccgccacaccggtgagggagccgggctgctctccagagccgttgtcctccacgctgcgtctcctgcctaaggagctcccaccccactgtctgcccagtggctgcctcctgtgcccccgggggaggtgtgaccccttacttccacctgcctggagcccatggtgttgagccgcctgaccgcaccctgggtcacttgccattgcattccaagcgtttccagttgtctgcataaaggactagcagcttctacatttccaactcaccatggaagagtctcagaatcagttattacgaaagctaaaggggcagaaacggacacaccagttcattttttactgggctcctctggctgctacaaagctgtgctcacacacgtctgtccttactcccacggcccaggatgccgtccctggacctgcccctgccagaccccacgtgcagcagctcggagcacgcagcgcagtctccgtccacttgggtgaatcccagggagtcctggtgttgtggtgctcccttctagacgtcctacctgcctggggctttccgccatgggcctgggtgtgctctctgtgcaagtgcagcccaaactgttctgtgtatacgtttggttgtgacacacccttgcttcaagtcctccagtggctccccattcctatcaagaacctaccaccaggcatggcctggacacagcccagactaccctccctgctgttaggaaactggcacagttttatctatggcgcgatctacaccctgatttacatcccaagctctagcccccgccgccattgctggaagccaggtggccacatggcccaacctctgtggtcaagctccaccccatcctaatgggattcgctgctcctgcttccctgcccgccctccagcaaagctttaataggacctgttcctgcacacgtgctctcttagctcctctcctcctctcgtctctcttctctcctctctgtctctctctctcttacagtctccttctctctttttccttcaccgccccacccctccagcctgttgggtgttccccaataaaccttttctcttactctggtgttcggtgtgttttgtgacggctgacacctgcagcctcacacccggccctggctctctctgccctcctggctgctccttctgcttggatcactgttttgcccatctgcctgggtcccactggctgcgttccccctccccacaacagccactctcctaggaggctctggctgcccagtgccccttgtctgggctggcctgaccccgccacacaggagttcggctccagtttggctctgccctggcgcaggtggggagtctcgggctcttctcacccggctccagttctttcccaggtctggccacagccccgcagggacaacaaaggtgacgactacatggagctggccggtgcagacagccggtggccggcactcttcctcctcacgccgctgtacgccaccttcatcatcttcaacaaggtgggagtcctctgtcaggggagacaggcgagacgccctcccaggggacgtgcaaggctgttccactaactctgagactggcaagggttgggggtgtcgtgtatgctgcctgggccccacagactgcccctcactgctctgcacccccaggctgtagcccctgtctggtcccagggctctctggcagctgagggagccccaaagttacagagaagagaagcccggcctccatgccccacccatggctgccagagagtggagagacccattctgtccccctctgtgcaaggagctgcctcagcccctgtgtccaccacagagattaacctcccagacccggagatgggtaccctcggctgcaggtgaagacaggtgccattttgctttggtcctgtgcctctgccagagcccccggccccacccagcaaacaaacggctccatgcgcctggctcctgcctctgggtcccagcaacccaggctcacctctgcccaaaggacagggcccagggcaagcagcaggaggacacacgcggggtgggtcctggccaccaccggagaggatgaatggagccttctgctctgaacgtcctcctctgcacagcaggcgcatgtgcacatgcatgcaagcacatgtgtagccacatacctcagacaacacacacatgtgtgcacatgcatgggctcacacatgtgcaatcacacacctcaacatatggcacacatgtgcatgcacacaccccatggaaatgagagcaagtgcaggtggagccccttgtgtgtgtgtctgcctcgacccctgctgtctgcgtgaccttgggcagagctctgagcccctacacctccacttcctgcactggaagtggctttcaccaggagagggggtgggggagacctctgaggggctctggaagactgtgcgttggtcactgcccaagaccctggacagctgctgtgggctctgagtcctctcgagctgtccccatggaagcctcactccaaggagctgcgacctttatgaggtcctcagtcatggggaacacctttcagtgtgcgaggaccaggacgatgaagctactgcctctgcctccatcactgcgagggacacgttcctgccaccgtgagcctcccagtctgtggcactcgatgacagcaggcaaaacaggcaagagacaccatcgtccagtcttcaggctgcccatgcgagagccaggactggaccttgttcagccggacctggtctcctcgccgtaccagctaagggcagagtcgggggtggggcttgcggctagcacctggctcagcaccacggctcttccatgccctgcctctccgctgaccagccgcaacacgggtgctgttccagtcctggcctcacacagcttctgcatgaagtctcagctcaactccctggtgctcgattgcgtgggcgccagtggttgcccagcacctctcacatgtaggacaccaaacctggaggtcagtggtcatccggacagggtcccacggggtcctcctgttaatttctggagcatcacacagcaaaatggagctgaaatccttgaagggaggatctgaagacagggatgggcccagagtatctgggatcggactgtggtctcgagtgccatgcactcaagcctgcatgccacacagacgtgtgtcagctcctgcacatagcatgtgccagacatgtgccaactccctgcacatagcatgtgccacacagatgtgtgtcagctcctgcacatagcgtgtgccacagactgtgccagctccctgcacatagtgtgtgccacacagacttgtgtcagctcttgcacatggcatgtgccacagacgtgtgtcatctcctgcacatagcgtgtgccacagacatgtatcagctccctgcacatagcgtgtgccacacagacatgtgtcagctcctgcacatagcgtgtgccacacagatgtgtgacagctccctgcacatagcgtgtgccacagacgtgccaactccatgcacatagcgtgtaccacagatgtgtgccagctccctgcacatagtgtgtgtcacacagacgtgtgccaactccctgcacatagcgtgtgccacagatgtgtgtcatctcctgcacatagcatgtgccacagacgtgtatcagctccctgcacatagcatgtgccacacagacgtgtgccaactccctgcacatagcatgtgccacagacgtgtatcagcttcctgcacatagcgtgtgccacacagacatgtgtcagctccctgcacatagcgtgtgccacacagacatgtgtcagctcctgcacatagcgtgtgccacagacgtgtgccaactccctgcacatagcatgtgccacagacatgcgccaactccatgcacatagtgtgtaccacagatgtgtgccagctccctgcacatagtgtgtgtcacacagacgtgtgccaactccctgcacatagtgtgtgccacagatgtgtgtcagctcctgcacatagcgtgtgcctcacagatatgtgccagttccctgcacatagcatgtgccacacagacatgtgtcagctccctgcacatagcgtgtgccacagacatatgtcagctcctgcacatagcgtgtgccacagacatgtggcaggccatgtcggtgatgggcttccacatcacagtcacgctggtctccctggtgctattgcctgaacctgaagattcagttcccccaggtgattctctggttcctcccctgcaccatctttgccatcccagagagggaccacactgcctggttgtcccagcaccctccagcccaggacccacccactcccacctcacacacctcccatcccatcaggctgtcatcatagctgccactgtcacccccagggctcctgccagctctcggcctccacacctctctcacccacagccatggcctccgtgcagcccaggcgcagagaacaaaatgcagcctggaactcgagcacagggccgcaggctcaccccagcccctctcctgcttggaagccagcaccacttgcctttcacacggcttcagcctctggccactgtcccctctcgcacttctgtccttgtcactgtccacctgcttcccactctgggttctgaccccagggagagtggagagcacacagggctggcacccagcagtcagagcagctgctctgctggcctcagagctgctgtcccgaagagaagaccggcttggtcttctggccaaagctgtgcgcgtgctgaggagaccctggtgtcatcccagctgtcaccctgctgtttctgcagaggggactgctggccttgccagttgccatttgtgctgtgccattcagaggccctgggaggactgtgatgtccacaccacagcctgtggcccacagtctcccctgaggacagggtgcctgctttggaccagatctgtgtgtgagctccctgactatctagggaacacagtacgtcatcctcaacagccttctcccagcgtcctcctttctaaagccagggctcatgggacttggccagatgctcagcccagacctctgcaaacccgccactcccagcccgccacactcgctcgcacccagccccacagaaggacacagggacctatcttcccacacacttcccctttctacatcagtgtccgttggtgttgaccacagagatccctgccggaggcatgtgacagggccaggtggcctggcgcctctgcaaggctgtggtctgcgcccttcctggcacccaagcacagacatcactcagcactgtgacctgtggtcacgcttcacagcccatctgtgtccccacagcctggctgcctggtgccagcagtgcaaacagcacctcagagcagaaccacctgtttccagccgcgacacaaacaggacgcacggcctcctgcagctaaatcaagagcttggtgggcctgatccgcccctgcggaactcacctccccaccaccacctgcggcccagcagagctgcctcgctgttagtgctctaggggcaagatccagcctgtcctgccctcctagactgtggactggggtctcccagacctgggcagaagccaggctgtgatttccagctccccgtgctgggaccatggctgggtctgcattcaccaagttttccctggaggacatatcacttgagagaaggcctgaaaagaaaattaaggggatgaaagagaaaagagacaggatttctgctcccattgtaaggacaaaacacactaatgtgcagcattgacacaaatcaatattcagatcagaagaagttgaggaaacagttacattctcttgggggtaaataagtgttttctcaaattaaaaaacaactgacagatttttgtcccccaaaggaaggaaatgaaatctatccaaggacaaagccaccataaacaaagcagatgctacagcaaagaaaatggccaaaccatccagcatcacactgcctgcatcttcccggagcctgagggatatgactatagacagaccagatggggacagacagagacaacagcgagacagactgtgcagcggtggagatgaggagcaaacagaggcagagacgatgctagagagaaagacaaaagatggacttggaaacgacagagggtgaggcagagacaatagacacaagcagaaaacgtaaggaattggctcaagaacttacagagctgaaggcagcctggcaggcgggacaccaggcaagagctggctccgcagctcgagcgccaagctcagctcgttggcagtattccctcctccgcagaggacctgtctgttttgtcctaaatcttcagtggattgaatgaagtctgcctgcattgtggagggtgatgggttatactcaaatctccaaacaccctcaccatctagactgcttagtatttgggtgagaatggagtcctatggcctcgccacgccagcatctaaaacagaccgtcacagagtctacataggtgaaggctggaaaacgtgatgcgtgccaccaacctggccttgaagtagaagattcaagtggaacattggggtgggggcaaggtcgcatctggcaagccgaagcgtgaatgaaaggggcggctgttggtgcagaacctcccaaaccagagtgcctgggttcaagtcccatctctgccaccccctccgggctcctggtaacgtacagcttggaagagagcgatggtggctgagatacgtgggagacatgaattgagtttcaggcttctggtccagccttggctattgtggacatttaggacctttcaaataaagaatttcaaagattttattgtgactaacaaacaaagcacatgaaaaaaagtcataaatcaccgaatacaagggacttcacacagcagatcattgccttagactacgcacacgggatgcacagacatgagatgttctgtaaaggaccaggagccagaagaggtcacagacaccagcacccggcacccaggccctttccttgaggggctctgcttggggtgagggaggtgcatcccgggcaggggcccgaggcagcgaggccctgggcagagctttgtgtcacccgctcccaggcagcaggaggtcagagggcatggaaagcagggctcaggaggatgggtggggccggactggcctcatccgggctcccgaccccttctgggaatagaggaagcccctggagggacttgagaggggtcctttgtgtccaaaccttgtgctaaggccacagatgggaactgtgccaggacaaaggagccccctggatatgtgtagacataccaggcctgcagactggacattccacaaccctgatgtagagaagaaagatggccctttcacaggaaaagagaaattagcagaagctgtccctgaggaagctcagacagcagacttactagacaaagactttaaagtaagagtcttaaatattctcaacaagctcaaggactactgtcccagcaaatagaagatagcaacagagacatgaatcattaaaagagatcaaagaaattgttgcgatacaaagtattgtaaaggaaatgaaaacctcacaaatcaacagcaggtttgagcaggtagaagaatcaatgagctgaaagcagttccactggcgatctccagcatgagaacccgcaggggcgtgggtagagggagcggtggtgccccatcgagctcaccagcaggggcgtgggtagagggagcggtggtgccccatcgagctcaccagcaggggcgtgggtagagggagcggtggtgcaccatcgagctcaccagcaggggtgtgggtagagggagcggtggtgcaccattgagctcaccagcctgagatgggtcatgaatctatacacaactgaacaataaaagctcattgaactccaataaaatacactcaaatgtgaagggaccaaatgttcctgttaggtgccaagggttgccaactttataaataaagcttattaaatgatgtttgcaaaagagaaagataaagtgtgaggctacagaaaacttgacagaggttaataaaagatgtgccacggagccaacactgtggcacagtgggttaagctgcttgcctgcagtgttagcatcccatgcgggcaccagttcaagccctggcttctccacttctgacccagctacctgcaaatgtacctgggaaatcagtggaagatagcccaagtacttgggcccctgcactcacgtgggagatcaggatgaagctcctggctcctggctactggctttggcctggcccagccctagtcattgcagccatttgtagagcgaatcagaagatgcaagagtctctctctccctccctctctctctctctctctctctctctcatcatcccctgtaactctgacttccaaataaataaataaatcataaaaaagacatgtcatgcaggtgttaaccaaagaaagttgctgctgctctactaaattcatacagagtagactctaaggcaaaaattatcactgggactaaatagaggcgataaaagactcagggaatatctatctaaaatctgactccaggaaacatacaacagaaattgacagaactacaggaagaattagataagtccataattatagtaggagatgttaacatttgcccaactttaactacagaagtagcagcatattgctaagcttgcccttcatttaaacattataaccaggaaatctcatatggtaggtgcacacagacttggatggagcagctacagaatgtcccttcaccccacgccatgtggaatacccacacattataccacttggtggcccagaaatgtttgcttgtgatgtggccacagtgaaattaagccagaaatcaatagcaaaaacacatatatgtagaaattaagaagtaaaccactaggcaacttttcagttaaaggataaatcacaacaggacagttaacatgtattaaacaaatagtaatggaaattctgcctttcaaaaatattgtggggtgaagcccaaatagtgccaagaagaacgcatatagcctcaaacacatataatatgaaggagaaaggcctaagaatcagggagctggggtccatttcaagaagtcaaaacagaatgttgaaagtgaagggaaaatcagttaaataatgtaagaaaatgactataatttactttagacaaaagtagacaataaaatgagtgaaattaataattttatcacccctctttaaccccagtaatgcttttggccttaaattctgttcttagagtctgtttttgtctgttgaaagtagaaggaaagaaatcttttaaataataaaagaaaatgattaaattgagtaaaagaaaacaaaactatgattgactaagccaattagtaaaattgatgaactcctcatggcatgagtcagggtgggcaggaagaaaaataaagtttcttccaaagaagagaccgagtccagctctctaggtggtgtcaaccctgaatctcctgcaacttaaatgctgagatgtatggtaaatcaacactgtggcatctgaagttgaagagcaggaaaaggcagggtggcatcaagaaaataatatgttaacaaaagtaaacttcatagcaaaagaaggggccatacgggaattccagcccctgccacctgcgcccacccagcctcccttgtgacatacgtggttgatgcctgcacaaaatgtgaccccaggatcttgtgccaggtgcttggtgacaaagaccggcatagtcccagatgccagggcccctgtgtgagtctactttgccaagcacgatgccgcctttacccccattggaccccagctgtctatgtgcgtctcttaagagccagaggccccagccgctgtccacggtgctgcctcagactgacacaacatgccgtgtttgagctgctgtccacagttctgctttcatttttctgtgtaacctaatgattatttctcctggagacagattttcctttaaaaaacaaatcaggatttcaagatggcagaataggtatcagcgtactgtgctaggctagggagaaatagtttaaaaaaaaaagagtgggaaatacattctcaagagggagttaaagagaaaacccagtggaaattcgatggaaggaagaggaagaccatggatctgtgtgcaaggtgcagatgcgcagcacgaacatggacacagcacacgactccagcagccgagagccagggaaggtgccagctttggagactgagatgaaatcaactgcagcaacctgtgcactgctgatatagctggagggagagcatgggcgtgagtctggcctggagcccccaggaggagagggcacctactgacccagtaaaaaaaagtggggcactctgctctcagccagtccccccacgacaccagccagcagccagctgagagagggcgagtgccaatctgggcataagtggcggcagcagagcccttgtgcatgtgcagacaaccggctgagacgctgcctccccccagcagtgctggcagcagcagctcggggagaaggagaaggtgacgtccagccaccagctcctgtgtgtgcatgtgctccagagattctagcagagggggagatccaagttcctctgactttgagtctgaccgagaggattgatgggggctgggcacccaggtagaactgtgagggtccccaatctcccaacataccacaggcgatggggaccccactgcctaagaggagcacccacgtgcagctggctctaggaagcagacaggctagcagagcagagtggatcctctgcaccccaggaccaagggagcctctgtgactgcacgaggggtgcagggcttttagctgggtctctgggaaatcactgtgtgcagccccacatgctcagggctccctgatcgccaggggtgggtcatggccacaggacctgtgctcacagggaggactgcacagatcctttggacagttcatatggctgcacagataaacattaacccactgagggctaatgcctggccattgatcacccagcaagagaggaggtgaggatgaggccacaccaacagaagcgaccctgtccctccttctattaccaagagatccaccatgaccaacgtgggtgtcaccctggacacttgccacaccctggagcactgaccagagctccttggccacacccagcacacacctctggtgttcactggaagtcagatattccattacgccacacaggcatagttcaaagataaaagccatcagaggaaaaatgaacacttatctccataaatgcctaaaagtaaatgcataaattcaagaaacaagaatgaccccccaaaggaacacaaaaacacttcaatattagaatgtgaacatgaagagattgatgaaatgcctgaaattgaattcaaaagattaatcagaagcaatgagaagcaaatccatgaattaaagaaatccatacttgacatgattgaaaaattttcccatgaaattgagatctaaaagagaaatcaaaatgaaatattagaaatgaagaattcagtagttcaaataaaaaatgcacgagaagccttaaagacagacttggtgaggcagaagaaggaatatccaggctagaagacaaatctttggaatttttttcagcagacagaaaaaaaaaggagaaattagaaaaattaaaaatagtgttggaggctggcgccatggctcaataggctaatcctccgccttgcagcgccagcacaccgggttctagtcctggtcggggcgccggattctgtcccggttgcccctcttccaggccagctttctgctgtggccagggagtgcagtggaggatggcccaagtccttgggccctgcaccccatgggagaccaggaggagcacctggctcctgccttcggatcagcgcagtgcgccggccacagcgcaccagccgcggcagccattggagggtgaaacaacagcaaaaaaggaagacctttctctctgtctctctcactgtccactctgcctgtcaaaaaaaaaatagtgttggagatttatgggattctatcaaatgactcaacacctgggtcttaggagttcctgaaggggtggaaagagagaatggattagaaggcctgtccagtgagataattacagaaaacttccccaacttggagaaagaaagggatgtacaagtacaggaagcacgtagaacccctcatagacaggaccagaaaagatcttcaccacgacacattgtagtcaaactgtcaacagtaaaacaaagaaaagattctaaaatgtgcacgagagaaacgccagattactttcagaggatctccaattggactcacagtgaacttctcatcagaaactctacaggttaggagagactagagagacatagttaaagtcttaagagaaaaaaaaaactgtcaacccagaatactgtacccagtaaagctctcatttatgaatgaaggtgaaataaacacctttcacaacaaacagatattgaaagaatttgtcaccactcatcagccttatataagatgcttaaggatgtgctgcacatagaaacagagagggccggcgccgtggctcaataggctaatcctccaccttgcggcgccggcacaccgggttctagtcccggttggggcgccggattctgtcccggttgcccctcttccaggccagctctctgctatggccagggagtgcagtggaggatggcccaggtgcttgggccctgcaccccatgggagaccaggaaaagcacctggatcctggctcctgccatcggatcagcacggtgcgccggctgcagcggcggccattggagggtgaaccaacggcaaaaggaagacctttctctctctgtctctctctcacactgtccactctgcctgtcaaaaaaaaaaattttttttaaaaaaaaaaagaaagaaacagagaaagacagtcatccttatgaacaaatgtgaaggcagaaaatcccccagtaaaagtataaagcaaatccaaaagtaaacaataggaatatctatgggaaaatggcagggccaaatcgttacttatcaatagtaaccttgactggactctaaacgctccaattaaaagacaacacgttggctgagtagattaaaaaataagacccatctatttgctgcctataagaaacacacctcaccaacaaagatacacgcaggctgaaaatgaaaggctggaaaaagttattccatgctaatggaaagcaaaaaagggcaagtgtagccgtcctaatatcagacaaaatagacttcaacacgcaaacagctagaagagatgaggaaggcaggcactgtgcagtgatcagggatctattcagcagggaggtgtggctatgctgagtttatatgcatctgacacaagggtgctgggctatctgaaagaactgttaatagatctaaagagagatatagactccaaaacaatagtagtgggggacttcaatacctcactttcagcaatgtagatcaaccagacagaaaatcaacaaagctaatcaacactatagaccaaatgggcctaactgatatctgcagaactaatcaccccacagttgcagaacacattcttctcatcactgcatggagctcaaggctcctggaaggatctcacggggacgccgctgtgggctgcgggtcaggggtcccgggaccccgtgggccccagagctgcaaccagcaggggaagggcagcagcacagacaccctcaaactacaccactctgatggaagtgtgaccttgagcgaggccactaaacagagctaatctggaaaaaaatctctctcccaaccagactctctccctactccctcccaccaccatgcgcaggcagtactgagacccacaggacagggtcccagtgacccagcagggagacagcaagggccactcctgcctcaggatcccacctggcagccagggactgaggcctgcccgggtccagtcaagcacagggccggtggtcagcagtctggctggaggggtagctggctggaggacttctctgtgaggtttcaagcacaggtacaaagaaggcacggggagtgctggctttctgctagagaaagaacactatggaacaagaagtaggattccagcccccggccggaggcaacgtccccttgtgcttcctgcctgggacagggccatgggttcccacgagacccactccccaggactgcgtgggcctggaaaagcaggaagccgccttggcaggggatttggagttagcccaggagcctgggaagtagctgtggaagtcatcacactggcgaatctcaggcaatgaaatgccacagggctgtcctcagggtcactctgctggggccgaactttaccaggggcagagttacccattgctgccccaatggccttgctggccctaacagacagcagcgctgggggtcctggggcgtcacagctgctgacctggacacaggtcgtgtccccggggacatccagggctgcgggaaagcttgagcagaactgccccgggtctcgccatcctggtcacccatgtacttctagagcattctgagccagggacaggctactctcagtgtggctgggtggtgatgttcaccaggcgtggggctcccagtggcacccgtgcacccacccatggcacctcgggggctgtgcagagctgggcggcccagccagaaggactgagcccagaaggccggcgctggctgagactacgctggcgacagaagcagccgggagagacttgccacttaggacaagtcgtggagagacagcagtcggaagggcgtgctcaccatacccaggggtcactgggtcgtttgcaggctttcctataggacgatgggtagaacctgggcagtgaatgtggctggggaacagctgggggcaggtctgttggctcagaggacccccatgccagcagtggctggaaattagaacgggggaggaggggctgtcgttccggcctagcgggtaaacctgccgtgccggcatcccatataggtgtcagctggagtcctggctgttccacttctgacccagctccctgctgatcagggaagggggaagcagcggaggacgtccaagtgcttgggcccccgcactcacgtgggagacccagaagaagctcctggcttcagcctggcccagccctggccgttgtggccatttggggagtgaaccagtggatggaagggctctctttctgtctcttcctctctctcaatcgctctataattctgtctttcaaataaataaaataaatctttagaaaaagtacacaagaacgggaagcccagctggaacaaggaccacgtccctggacgctggccagggcggtccctgcaaccagtggcagaggacctggctgggccgcgtttcgctattttgttgaaagtaaacgtggaggccatgactcggatccagagctgagctttctaagccgggtgtggaagacacggcctggctcctgcttgccgctaatagcaagatgtgagaggagggaaacaaattaactagaaaactgctaggcaaagacgcactgcgcgtgaggagtggggaaattctcagcctgtctggggacagagccactggcatggctgcacagccattggcaaagagatggcagaggggacactggctccagcctggcatcttggcaaagccaggacaaagaggggcaggaggctgcctgggagacatctgcgggctgtgccaggagacatgtgggtgggttgagggcgctcatgggttacatgggagcctgatggtggaggctggcagggaagaacaaatgaaggagggagcactttgaggccagagccaagatgcagaggttgccactgtcctgcggggccaaggtcagagcaacgagactgcaatgccctccagcctcaggacctgccaggcgctgaacgcctcgggacccggacgcctgtctgcccccaacctctcccctggccactgggaactgcccccactgctgctgtcacaggaggaattcgcttcagcgtgaaccacgccctcccgctgagtctcacgcacccccggtgcaggcagtccggccccacctggaaggtgcactgactgaagacactgcaaggggtgagagcatttctcaggaaagagccctgagtttagaaggccagagagcagagggctgagggctgccttgcgctgcaacccatggaaacacaggcttagcagatgttcaagctccgggagtctacactgggtgagggcaggcgtccagcctgacatggcccccacagacgcgcccacaggtgacgccagatggggacggtcaaggatcgggggatcctacatgcccaggggcaccaagacagccaggagagcaccagaggccacaagagaggcctgggacagtctccctgctgacatccagagcccaggccccacttggcagagctggctgagaacacgtctctgcggtggaagctgccccgtcctgggtgttgctcggcgggctaagccgactgacgcggggcgggccaggccatcggccccacggcctgcagcttcctccccagcccaggctgcgtgggctcctggctgaactggccgctcactgagctctcacccccccacccagcagcaggccgggcggtgctgccatgagctccattcccaccacacgagcgacagcccgggcagcgccccaggcccacggggcgtttgctgtgcggctcgcactcgctgctcagggccagcgcagggtgcagcagggactcaccaacccgccccgactcggctggcacgtttactggaggcctctgagcctgaccgtggcagtggggcccgagcaggctccaggctgccccctgcaccctgggcttgccgctccgggacccctggtgggcaccttcccagatgtgctcccaccgtgcctccttggggctctgggctcacgcggtcactctccgccttctctcctcccgtctcctgcctcctcccagccctttcctgcctccctatggccccatctagctctgccctctctagagcctctacctggaaggaatctgctgttggaccaagacactacccgcagcacaggtgggcgccttgcactgtgctaggccctccccgcacagcatcagggccctagtctctggaggctgctgctgtctctggggctggcatcaggcgcaccctgcaccctgcaccctgaggaaactcaggcctgcccgctccaggcctgtcccctcagcccctgggccctgccagctgctcctctcccctacctggaccccagcccttggcagcccccactgaggccctgagtggacccccgctgccccagatccccataagctcctggtacagaacacgtccctggacctgagagccacagcccatcaggttccccagagtggccaccccaggggccttccttgtccagggtctcctctcccagtagccacccatgcccctcgcctgtgagctgggcagggctcccagccccaggggaggtcacctgggctgtcctgagggcgagcagcctggagagagggacgccagggctcaggggagaggctcaggcacagagaggtctgagtcctcagagaaggaggcagggcacagggaccctggcagagcaacagtgctggtcgggcacctgcctcacccagcccccaccagcacctcctcctgcctggggcctgcaccccacacccagaaacccccagcagaaaagggaacttgaggaggccccgtgccacccgtttcaatcccgttcttagtgtacatggaggggcaaccagaactgcctctcctgggagggcagctgcggtggcagagcctggggccaccctgggaagggctccgagcacaaacaccagggctccgggagggtggggacagacggtgttggggcacccaacaggcacaggtagggggaggggctagagagagaccacccctcccggaaggcccaggcctgggcatggacaacgacacacacaggccagtaaagcagcccaagagtgcctccagcatcaggaagaggcctgaggccaggctgacccacgcccgacacagcaccgagcctgctagggctggaccggcagagcgcaggtgttgccgtggacggcctgggctgagatgaggacaatacaggggagggagggagacccacaggccaagggtcctacccaggccaaggtggcaccctcagtccagggtagcatctgaggtggtggccggagggcctggtcccagctgggccagggcagcaggtgagctgggagcagagcaggcgaggcaggccacgcagagccagctgacagagaaaggagtgccagcttggtgggggtggagcccgggactgacggggagggaaagggaaaaacgcaggagaccagggcggatggagagctcagggtagggagttctttccggaggcatccaggaaatctgtctaccctcactggggccagcagagcgcaggtgggatgggggcatggggcaggagatccagcagagtggggggcatctggcagaacccccagacctggaagaatgggaggggatgcgtagagagccctgagcttatctgagaaggcacaggcaggagcggtgctctggtgaggggacctggctgcacaccggccaaatgccagaagacagaacgagaccacttggcagagagggtagcaccagagggacagcggtgaaaggtcagagaccacgtgagcaggggctatgacaggactggacgggcaggagcaagcatccagcatgagtgcagaagccaggcacagaacagctacaggtgagcaggggcaggtgggagggctggaaagacaggggcagctccaggagtccatgggcaggggagagcagctacaggtgagcaggggcagctgggagggctggatgggcaggggcagctccaggagccaaaaaccaggcacagaacagctacaggtgagcaggcacaggtgggagggctggacgggcaggggcagctccaggagtccacaggcaggggagagcagctacaggtgagcaggggcagctgggagggctggatggtcaaggacagctccaggagtccaggggtcataggagagcagctaccggtgagcaggggtagctgggagggctggatgggcaggggcagctccaggagtctgcggccaggggagagcagctacaggtgagcaggggcagctgggagggctggatgggcaggggcagctccaggagtccgtggccaggggagagcagctaacagtgagcagaggcagctgggagggcaggggcagctccaggggcccagaggccagacacagagcagctaccggtgagcaggggcagctgggagggctggatgggcaggggcagctccaggagccaaaaactgggcacagagcagctaccggtgagcaggggcaggtgggagggctggatgggcaggggcagctccaggagccaaaaactgggcacagagcagctaccggtgagcaggggcaggtgggagggctggatgggcaggggcagctccaggagtctgcggccagggtagagcagctaccagtgagcaggggcagctgggagggctgaatgggttagggacaggtccaggattccaggggccagggacagagcagctaccaatgagcaggggcagctgggagggctggacgggcaggggcagctccaggagcccagaggtcatagcagagcagctaccagtgagcaggagcagctgggagggctttatggacaagggcagctccaggagcccagaggccaggcacagagcagctaccagtgagcaagggcagctgggagggctggatgggcagggacagccctaggagacaaggggccaggcacagagcagctaccagtgagcaagggcagctgggagggctggatgggcagggacagccctaggagacaaggggccaggcacagagcagctaccagtgagcaggggcaggtgggagggctggatgggcaggggcagctccaggagtccgcggccagggtagagcagctaccagtgagcaggggcagctgggagggcaggggcagctccaggagcccagaggccagggacagagcagctaccaatgagcaggagcagctgggagggctgaatgggttagggacaggtccaggagtccaggggccagggacagagcagctaccggtgagcaggggcaggtgggagggctggacgggcaggggcagctccaggagcccagaggtcatagcagagcagctaccagtgagcaggggcaggtgggagggctttatggacaagggcagctccaggcgcccagaggccaggcacagagcagctaccagtgagcaggagcagctgggagggctggatgggcaggggcagctccaggagccaaaaaccaggcacagagcagctaccggtgagcaggggcagctgggagggctggatgggcagggcagctccaggagccaaaaaccgggcacagagcagctaccggtgagcaggggcaggtgggagggctggatgggcaggggcagctccaggagtccgcagccagggtagagcagctaccagtgagcaggggcagctgggagggctggatgggcagggccagctccaggagtccagaggccaggcacagagcagctaccggtgagcaggggaaggtgggagggctggatgggcagggcagctccaggagcccaggggccagggacagagcagctaccagtgagcaggggcagctgggagggctggatgggcagggcagctccaggagcccagaggccagacacagagcagctaccggtgagcaggggcaggtgggagggctggatgggcaggggcagctccaggagtccgcggccagggtagagcagctaccagtgagcaggggcagctggaagggcaggggcagctccaggggcccagaggccagggacagagcagctaccaatgagcaggagcagctgggagggctgaatgggttagggacaggtccaggagtccaggggccagggacagagcagataccggtgagcaggggcagctgggagggctttatggacaagggcagctccaagagcccagagaccagggacagagcagctaccggtgagcaggggcagctgggagggctagatgggcaggggcagctccaggtgcccaggggtcatagcagagcagctaccagtgagcaggagcagctgggagggctggatgggcaggggccagggacagagcagctacagagcaggggcaggtgtgagggctggacagacagggacagccctaggagacaaggggccagggacagagcagctaccggtgagcaggagcagctgggagggctggatgggcagggacaggtccaggagtccaggggccagggacagagcatacaggtgagcaggagcagctgggagggctgaatgggcagggactggtccaggagtccaggggccagggacagagcatacaggtgagcaggggcagctgggaggcagcagggtcagggcagccctgggagatgctgagtgagggtgagtgtccggatgtcctaggctggagcaggagctgagcagctgctcagaaggggcagctgaggctcaggcagcccaggtggcctctcccttgggagcagtggcgaccagtgggggacagctggatggagctcagggagccaggccccgctcacaggtgggtctagaagtttccgagagagagagaagctgcggtagagagagacccagagctgctccgagaggcggccctgggcaggaaagggcccgagagatgccgctcaccaaggatctctgtgagctgcagttcatgggtccgggtgtggcagtgttggtggctggtgggaccacggcacaggagggcacccacgccaaagcagctggaggtacaggggcagctgtccagggcccagagccagcggatcagcacccgagcgaagcttacttgttgggggcgggcaggtctaagggcacctgccaggtgtgggggctgggctgactcagcaggagccttctagaaggaaagctctggagaaggtgggggcagagggcgggaaaggcctgtgaggaggcgggtggtgggcagggccactgggaagggagggctgggggtgacactcaggttggcactggggaggacctgaggaggcaggtgccaggcacagagctgaacctgggcagggcaggggcaggtaacaagaaggattctccttggagcctggtccagggtggtccagggcggtccagggcctggggtttgcaagctgggctgtgacagggcctctctccccaggggcaagcagcaaagcctgggcacagagcccaaagcccccacacagagaagctccccagggcagggcctgcagggcttgggggaccttcttggagcaggcagaggacagaggcatgagatcagcctcccagaggctggaatgataggtccagcaggaggggcccacatgggctctggttagcaggagaaaacggcccccaggtccccatggccaccacgcaccgactgctggtgaagctttgggtggcagacgagagccacatgggcagctgctcctgtcactctctgggagtgcatcgaggggcaagactggccaggtggcctcctgacgccctcaggcccagactgtagacctgcctggcccctgccaaggtcaggggtcctccagggcaggggtcacattgtgccccttctcttgcagg

SEQ ID NO: 64 - DNA, 205 bp, Oryctolagus cuniculus
gtgagagcacaggaggtggggtccacaggacacgaggccggggcaggtgctcctgcctgtactgcccctgaaggccactgtgcactcctgggcacacagcggggctcttggccccctggcccagaggagcctggccctgacctgagtccaccccaatagccagcctctgcaggccccagtaaccccagtcttctttctctgcagc

SEQ ID NO: 65 - DNA, 98 bp, Oryctolagus cuniculus
gtgagtcccattagcctcaccctctagccccagcccggggagccccaccccagggtgccccccaggtgttgactcttccccgtctctcccactgcagc

SEQ ID NO: 66 - DNA, 93 bp, Oryctolagus cuniculus
gtgggagccgcgggctgggagcagggcaggcagctcccacggcccgaggcctccgcccgggagtgaccctgtgctgtccgctgtccccacagg

SEQ ID NO: 67 - DNA, 2039 bp, Oryctolagus cuniculus
gcgctgtgccggcgagctgcccctctccctcccccccacgccgcagctgtgcaccccgcacacaaataaagcacccagctctgccctgagaggctgtcctgattccttccaaggcagaggcttccactcgggccggacagggttgggcgggcgccgtgggctctgctgtggccagcagccagaacggtcaacagtgggacaggggcagacccacagcacaggggcctgccaagaactgggctcagccggagtgctgtggcaggtccccccttgcagctagcacgtgtgtgctgggcaggcagaggcccccaggggaggagcacacagctaccacctctgcaagagcctggcctggcgcccaggtcccagtccacagggtgtgtgtacacagagcctcatcttaccacagatgtagggacagacccaccacgcccctgcaccccacccagcctcgccccttgtgggaccagggctaccactccactcccccgcccagagcagcagaagcaggtggcatcctcagcagagggacagtctcacccctccacggcactgagccctgacccatcaaacaagcccctcctgctgcacagcacctgtgtgcacatcacacacacacacacacacacactgaggcctgaccccatcctgccctcctgctgcatggcacctgtgtgcacatcacacacacatgcacacacacactcacacacactgagccctgaccccatcctgccctcctgctgcatggcacctgtgtgcacatcacacacacacacacacacacacacacacactgagccctgaccccatcctgccctcctgctgcatggcacctgtgcacacatcacaaacacgcctgcctcatacactggcactcagaaggggcccctgtacacgcatacacatgcacacacctcacacatgggccccctacacacgcatcacacacactcatgcacactcctcacacatggccctcctgcacatacattgcacacacatgtgcacagacctcacaatgggcccctgcacacacattgtacacacgcatgtgcacacacttcacacatgggccccctgcacatgcattgcacacacagacacacacatgtgcattcctcacacattggggccttgcaagggatgccctgcacacacattgcacatgctcacatgtgcacacaccccacactggagccttgcatagggccccctgtacacacatcatgcatacacacacacctcacacaaggggccccctacatacgcaaaacacacacacacacatgcacacacctcatacacgggccccctacacacatcacacacacacacacacacacgtatgcatgcctcacacacagaccttgcaaggggccccctgcacatgcatcaaacacatatgcacatgtttcacacacacggtcccctacacacactgcacacgcacacatgtgtacatgcttcacacactggggccttgcatggggtcccctgcatagcatagcacccagagccacgccaggtgcctgggcacatggacactggtgcacacacagcacccaagcccagctctcccatccaaggggcaccagcaccccccactcacgagcaccctgaattcctgctccccacaagcgaacgtgcaccctacctctccagacgtccctttcctgtggccactcccataggtattggcgagaccctcccttgacccttgggcctggtcacccaggggacaggagagggccaagttgggccacagtaccactgcccagcaggggtgaggcaagcagagggtgggtctgtgaggcgtctggccagccgtgctggggcccaggtggggagcagctgggtggctgaggtggcttccttgcaggtggttggggggagctggccccacaagtgccactgcccagcactgtccagtgcttccccctgaacctcccggccacccatccccagctgcagccgcagagggagtgcccctcggcctcctcggcaagacgcacgctgactgcccctccccatccaga

SEQ ID NO: 68 - DNA, 2260 bp, Oryctolagus cuniculus
gcgctgtgccggcgagctgcccctctccctcccccccacgccgcagctgtgcaccccgcacacaaataaagcacccagctctgccctgagaggctgtcctgattccttccaaggcagaggcttccactcgggccggacagggttgggcgggcgccgtgggctctgctgtggccagcagccagaacggtcaacagtgggacaggggcagacccacagcacaggggcctgccaagaactgggctcagccggagtgctgtggcaggtccccccttgcagctagcacgtgtgtgctgggcaggcagaggcccccaggggaggagcacacagctaccacctctgcaagagcctggcctggcgcccaggtcccagtccacagggtgtgtgtacacagagcctcatcttaccacagatgtagggacagacccaccacgcccctgcaccccacccagcctcgccccttgtgggaccagggctaccactccactcccccgcccagagcagcagaagcaggtggcatcctcagcagagggacagtctcacccctccacggcactgagccctgacccatcaaacaagcccctcctgctgcacagcacctgtgtgcacatcacacacacacacacacacacactgaggcctgaccccatcctgccctcctgctgcatggcacctgtgtgcacatcacacacacatgcacacacacactcacacacactgagccctgaccccatcctgccctcctgctgcatggcacctgtgtgcacatcacacacacacacacacacacacacacacactgagccctgaccccatcctgccctcctgctgcatggcacctgtgcacacatcacaaacacgcctgcctcatacactggcactcagaaggggcccctgtacacgcatacacatgcacacacctcacacatgggccccctacacacgcatcacacacactcatgcacactcctcacacatggccctcctgcacatacattgcacacacatgtgcacagacctcacaatgggcccctgcacacacattgtacacacgcatgtgcacacacttcacacatgggccccctgcacatgcattgcacacacagacacacacatgtgcattcctcacacattggggccttgcaagggatgccctgcacacacattgcacatgctcacatgtgcacacaccccacactggagccttgcatagggccccctgtacacacatcatgcatacacacacacctcacacaaggggccccctacatacgcaaaacacacacacacacatgcacacacctcatacacgggccccctacacacatcacacacacacacacacacacgtatgcatgcctcacacacagaccttgcaaggggccccctgcacatgcatcaaacacatatgcacatgtttcacacacacggtcccctacacacactgcacacgcacacatgtgtacatgcttcacacactggggccttgcatggggtcccctgcatagcatagcacccagagccacgccaggtgcctgggcacatggacactggtgcacacacagcacccaagcccagctctcccatccaaggggcaccagcaccccccactcacgagcaccctgaattcctgctccccacaagcgaacgtgcaccctacctctccagacgtccctttcctgtggccactcccataggtattggcgagaccctcccttgacccttgggcctggtcacccaggggacaggagagggccaagttgggccacagtaccactgcccagcaggggtgaggcaagcagagggtgggtctgtgaggcgtctggccagccgtgctggggcccaggtggggagcagctgggtggctgaggtggcttccttgcaggtggttggggggagctggccccacaagtgccactgcccagcactgtccagtgcttccccctgaacctcccggccacccatccccagctgcagccgcagagggagtgcccctcggcctcctcggcaagacgcacgctgactgcccctccccatccagagctgcagctggacgagagctgtgccgaggcccaggacggggagctggacgggctgtggaccaccatcaccatcttcatctccctcttcctgctcagcgtgtgctacagcgccacagtcaccctcttcaaggtgggtgctgcacccggcacgggtgggctgggggccaggggcgggggccgggggccaggccctcctcaccccgcgccgccgctgctgcagg

SEQ ID NO: 69 - DNA, 12301 bp, Oryctolagus cuniculus
gcgctgtgccggcgagctgcccctctccctcccccccacgccgcagctgtgcaccccgcacacaaataaagcacccagctctgccctgagaggctgtcctgattccttccaaggcagaggcttccactcgggccggacagggttgggcgggcgccgtgggctctgctgtggccagcagccagaacggtcaacagtgggacaggggcagacccacagcacaggggcctgccaagaactgggctcagccggagtgctgtggcaggtccccccttgcagctagcacgtgtgtgctgggcaggcagaggcccccaggggaggagcacacagctaccacctctgcaagagcctggcctggcgcccaggtcccagtccacagggtgtgtgtacacagagcctcatcttaccacagatgtagggacagacccaccacgcccctgcaccccacccagcctcgccccttgtgggaccagggctaccactccactcccccgcccagagcagcagaagcaggtggcatcctcagcagagggacagtctcacccctccacggcactgagccctgacccatcaaacaagcccctcctgctgcacagcacctgtgtgcacatcacacacacacacacacacacactgaggcctgaccccatcctgccctcctgctgcatggcacctgtgtgcacatcacacacacatgcacacacacactcacacacactgagccctgaccccatcctgccctcctgctgcatggcacctgtgtgcacatcacacacacacacacacacacacacacacactgagccctgaccccatcctgccctcctgctgcatggcacctgtgcacacatcacaaacacgcctgcctcatacactggcactcagaaggggcccctgtacacgcatacacatgcacacacctcacacatgggccccctacacacgcatcacacacactcatgcacactcctcacacatggccctcctgcacatacattgcacacacatgtgcacagacctcacaatgggcccctgcacacacattgtacacacgcatgtgcacacacttcacacatgggccccctgcacatgcattgcacacacagacacacacatgtgcattcctcacacattggggccttgcaagggatgccctgcacacacattgcacatgctcacatgtgcacacaccccacactggagccttgcatagggccccctgtacacacatcatgcatacacacacacctcacacaaggggccccctacatacgcaaaacacacacacacacatgcacacacctcatacacgggccccctacacacatcacacacacacacacacacacgtatgcatgcctcacacacagaccttgcaaggggccccctgcacatgcatcaaacacatatgcacatgtttcacacacacggtcccctacacacactgcacacgcacacatgtgtacatgcttcacacactggggccttgcatggggtcccctgcatagcatagcacccagagccacgccaggtgcctgggcacatggacactggtgcacacacagcacccaagcccagctctcccatccaaggggcaccagcaccccccactcacgagcaccctgaattcctgctccccacaagcgaacgtgcaccctacctctccagacgtccctttcctgtggccactcccataggtattggcgagaccctcccttgacccttgggcctggtcacccaggggacaggagagggccaagttgggccacagtaccactgcccagcaggggtgaggcaagcagagggtgggtctgtgaggcgtctggccagccgtgctggggcccaggtggggagcagctgggtggctgaggtggcttccttgcaggtggttggggggagctggccccacaagtgccactgcccagcactgtccagtgcttccccctgaacctcccggccacccatccccagctgcagccgcagagggagtgcccctcggcctcctcggcaagacgcacgctgactgcccctccccatccagagctgcagctggacgagagctgtgccgaggcccaggacggggagctggacgggctgtggaccaccatcaccatcttcatctccctcttcctgctcagcgtgtgctacagcgccacagtcaccctcttcaaggtgggtgctgcacccggcacgggtgggctgggggccaggggcgggggccgggggccaggccctcctcaccccgcgccgccgctgctgcaggtgaagtggatcttctcgtccgtggtggagctgaaacacaccatcgctcccgactacaggaacatgatcgggcagggggcctaggcccttcgttctcacagcctgcctccctggccagcaggagcccccgcctccgcctcggaccccatggctctctgctctggccgctccggacccctccgcctcgggagaagcgcgcagctgatgcctgccggcccctccacgcagcagtgcggacagcacgcatctgtcgtccacccggcaggaccccacccagggccagccctgaccgccagcctcctggactcagggctcctctgagaaaaggcccacttgttggtcccctcagcccacacccaggcagcctccggtgggtgcttccctggaccccagcctgaggcctatgcttgttctcctgtggctcttactcagaggcccgtgctggactcccacccacagggacagtgccctgctccaaccctcactgcactgggggtcatggggccaccttctgtgcaggggtcctggctccaaggagaacactcgaagggcctgcttggccacctggcaccacgggagccccgctgggtagcttggcagggacccctgagtagaggtgggtgcacccagccagaaagcctgctggatggacaggagcctggcgtccgggccccaggcaggcagacacggcttcatggacaggagaggccaaggaacatcagcaaagagagacagctgggccgggcgttccagccagacccatcctgcagcccagcatcgggccccgtgtcactcacagcagggacagccagtctgactcgatgaccgtgaagccctgctgcccagggagccacgacaggctggccgccctcactggacagaggcccggctctttctcgcccatccctgttttggacagacactataacagtctccagacaagagggagaccccataggagagggacatggacgcctgcctggaccactggggaaaccacgcagaaattgtttctgtggccctagctgcggtggctttctgctgtctttgttgtctgcagccccagagctgtcccggatgtctcttcgtgaatgagaataaagcgtcctcagggaatcctgcacctgcagccccgttcctgtggccacgccagggcagcttccaccgtccaccatccaccatcctccagcccctgtgcaggcctccccaccccatactgcatgcccctggccactctggtggacagtgtgtccctggccaatctagtgggcaccatatgccccttgtcactctggtggacaacgtgcacccctggtcactctggtggacaccgtgcatcactggtcactctggtggtcattgtgtgtccctggtcactctggtggacaccatgtgctcctggtcactctgggggataccatgtgcctctggtcactctggtgggcaccatgtgcccctgatcactctggtagacattgtatgctcctggtcactctggtggacattgtgtgctcctggtcagtctagtagacaccatgcacccctgatcactctggtggacaccagacacccctggtcactcagtggacacgttgtgttcctggtcattctggtggacaccatgagtccctggtcactctggtagacaccatgcatccctagttattctggtggacacagtgtgcccaggtcactctggtagacacaatgtgcccctggtcactctggtggacaccgtgtgcccctggtcactctggtggacactgtatgccccggtcactctggtagacaccgtgcacccctggtcactctggtggacaccgtgtgcccctggtcacactggtggacactgtgtgcccctggtcacactggtggacactgtgtgcccctgatcacactggtggacactgtgcacccctgatcactctggtggatattgtgtgtccctggtcactctggaggacaccgtgaacccctggtcactctggtggacaccgtgtgcccctggtcactctggtggacaccatgcaccctggtcactctggtggacaccatgcacccctggtcactctggaggacaccgtgtgcccctggtcacactggtggacactgtgtgctcctggtcactctggtggacaccgtgcatccctggtcactctggtggacacaatgtgcccctggccactcttgtagacaccatgtgcccctggccagtatggtggacaccatgtgcccctggtcagtctggtggacatcattagtccctggtcactctggtggacactgtgtgctcctggtcactctggtggacactgtgtgttcctggtcacccctgggggacaaagtcaatggatctgagggccctgctggcctcaggggcaaggctgggactgacctcaggctgccctgcaagaccacagggaggcccccagcaaccttgcaagcaggagccagaagcatgttgggtctgtgtgcatcagactgccacgaagcccacagaccgtggtttaaaccacagaaatcgtctcgtggtcctgaggccagaagtccaagtccacgtgtccagggctggaaccccgggagggctgctctgcccagtgtgcagacaccgcctactctctctcgggccatcacatgacacacacacctgccacagcacaacgatgtcacgtgacacacacacacgcacacgtggtcacacagcctcacacaaggacacgcgtgcctgcagttcccttgtgcgtcccaaggctgtcacgctgccccacacctccagcctccacgctcgcagtccctcggcccctgtcccttctgtgcccactgctcactcctcagcctcagtgcccggtccctggcatcggtccccagcagccagcacagtggcccgcctcttccactcagggcccaggggcctctcccatgacacccaggcacagtgggcagggcaggcccccctctcctctggagccatctggtcccttcctcttccccaggcctggagacccctgtgatgtcacaccttccctatgccccacccacagccagctccacttcgtgttcccgcccagagcctggcacccatgtgggcttggggctgggtcgggggcaaaggttggtgaaggggccaaagccacaccacgagcatgagccccccttgcctgctgtcccagagctccttccacgcctaaactgcacagagccaggccatgggaaggagacagagggggacagtagggcaggtgcagagccaggagggcgggaggacaggggggccagactcatgctggcctcaggatgcagctcccaggctctttcctcctgtggggaaccagacagagccctccttgctccctgcacccctgcctccacacagcaggccctctgatccagcaaggggcatgcccaccaccgacgaaccagcctcagctgagaaatgggtgcaggagcagccagggcctggatccacctgtgtgctctcctgttctgagaagggaacattccagaagggcctgctcctttgcccgggtcccaggacaccgtggccccacaaaccgcagcccacacatgtgtataagcaatggacttgtgcttctccagcctcctcacctggggcggggcctggggctggggttgtcaccactccacatcagacaaagccaggggacatggcccccgctcacgccactcccactgcagtgagcgtgaagcagcgccgagaccgcgcacagcatctggctttcacagggtttccagagctgttactcagggtcctccagagaagcaaagccagtaagacggtagataacacagacggataacggacaagagagagacaatacacaatacttcgatgcgtggatagatacatgatagcctgacagaggatatgcagaggtagatggcagacacatggagacatgggtgacatatgagatgccgctcgggacaccacatcccagatcagactgtctgggtccagatccctgctcctcttccaattccagccttccgggaggcagcaatgacagctccagtggccgggtccctgtcactcacatggcagacctggggctcctggttcctgcccacagtctgggcagtcccagctgttgcaggcatttgagtgaaccaatgggtggaagatctctcgctacctctctcactcttgccatcttgctctctctccctctctctctctctctctctctgcctttcaaataaaagtgaatgaatgggtggatgggtgggtggatgtatgggtgggtgggcgggtggatggatgggtggatggatggatgggtgggcgggtggatggatggatgggtgggtggatggatgggtgggtggatggatgggtgggtgggtggatgggtggatggatggatgggtgggtgggtggatgggtggttggatggatggatgggtgggtgggtggacagatggatggatgggtggtgggtgggaggaagggtgggtggatgggtgggtggatggatgggtgggttggtggatgggtgggtggacggatggatggatgggtggtgggtgggagggagggtgggtggacgaatggatggatgcgtggtgggtgggtggatgtgtggatgggtggatggatgggtgggtgggtgggtggatgggtgggtggtgggtgggaggcagggtgggtggatgggtgggtggtgggtgggagggagggtgggtggatgggtgggtggatggatggatggatgggtggatggatggatgggtgggtgggtggatgggtggatgggtgtgtggacggatggatggatgggtgggtggtgggtgggagggagggtgggtggataggtgggtggaggggtaggtgggtgggtggatggatgggtggatggatgggtgggtggatgtgtggatgggtggatggatgggtgggtggaggggtaggtgggtggatggatggatgggtggatgaaattttaatgtaaataaaaataacttgaaggcactgggacaatgctgaaagccaactctggaaatgattcttttctgagagtgtttgtccaaaggcgcatcccaggccctgcagcaggtgcaactggaatccagacagaaaaccgaagccttcctggatgaggaacagggtccagagtggctgaagttcagggcagacgtccctaagaggagggagagcagaaagctgcggcagctctgcccacgtctcggctgaaaggctcagcgtgggaatggagggaaaacgaccaagggccccgcagacagcagtgccgctgaacatggagaactcggacgccagccgtctccccacccgtctctccacggggaggagtcggggcaatccctggagacctggcagggctgcccctccaggtgggagcggcagaggtgaggcagagactcgggtggagcccgctgtgcgccccccgaggggacagacagcctggtcccctctaaagctgggaccctggggcagcagaggctgtgggtgggctgtgagactgcggcagctgtagcggccacgagcctccttcccagggacacacggcgcctccagacacttcgctcctgctggggagccgggctaggccctgccctgaatgcccacagcctgccgagcactagctggaaggcaacaggcctggtggctcccgcccgccactcagtgcagcacagctgcgggcctcctggcctgggcctctgccccgacacctctggggtttcctcagaatcgtggtccttctaaggaaccagccttcactctctgtctcccacggccagagggaggggctgtgggcttggacactgcctgggaacaagggggtcagctgggcccaggccctgcaggcctcaattcaaggcctccaggcccctggccctgggccaggttcagcccctccgtgctgcagccctccagggacttccaaaggtgtcgagcccccgccttggccacaggcctgtcagagcccggcttcttcagccccaactcagaggccggggccgggtgtcctgggggacaacatgacttctccaaggtggccaggctcaggctcaggaccccaggctaggagccaagctggcagtgtccacagcttcccactgtgcactcgggcctccagggacagctagggacacctggccacacatgggccggaaaggaaccacgaagccaagaggcagcgtccaccagcccatggccttaactgtgtccctgcagcccagtgggcactgcagccatgcctggcactcgagcgctcacttgctggcctcccatagtcctctctggccgggcagcccagtgtcagccctgaggtgccctgccccccccctcagctgcacctgcaggtaccacctcagctgccagcaccaaggcccaggctccttcacctgccctgggcacactggcccaggccagctccctgaagaaccacaaagtggccacttccctcccctggcaaggctgctgtgggcacagatggaggtgaccagtgcccacccaccgaggctgacggggtgcccacccatctgctcgcaggtcagggtgagtttgtacactgggcaggggcctgcagcaaggacagaacccgcgtgagcatgtggcacaggggcctccctcacctgaaaccccgcagtcctcacccagcttcccaagaacagaacaatggcaacttccggggctgccagggccgggggttcccgccccatttttagcccagggcactgaggcagagctcccctgtctccagaccgaccgctcaggtgtaaaaacggcaacaatgattactaacgcaccacacaccccgagccttccagggaccagccgctgccgcagatcgggacagccacgccggccgcagccagtgcacggaggacctggccctcaggtatccaagcccacagggagcctacgcagggctgcccgggccacagcccagagtgcatactgggctgccctccccgtgtggaccacaccttttggtcactaagtgtccatcagttgtccccagcatggagctagaagcagcctcaagctaccctgggaaaggcggtggttgtggacgtccatgggacaagacaggactggaccaggcccatgatgaggacaagcagggtcagctcagaggctccaggctgggcatgaacctgcctgcaaccactcaagatgggacggtcacccaggatgggccacgggtggcagcaggtggctgccctgtgctgggtggcacaacaggtagccacagtccacaatggctgggctgtcctgcctgggatgggctggactgagctgagttaggcatttctgctggactgggctcagctatctgggctagactgagctgggatgggctgggctggactgggctggactgggctgagctgagctgagctgagctggactgggctgggctaggctgggctaagctgggctgaactgggctgggctaaactgggcaggctgagctgagctgggctagactgagctgggctgggctgggctaaactgggcaggctgggctgagcagagctgggctgggctgggctgagctgagctgggctgggctgggctgggctgagctgagctgggctgggctgggctgggctgggctgggctgggctgaactgggctggactggactgggcaggctgagctgagctgggctagactgagctggatgggctgggctgggctgggctgaactgggctgagctgggcagagctgggcttggctaaactgggcaggctgagctgagctgggctgtactgggctggctgggctaggctgaactgagctgggcagaactgggctgggctggattgggctggctgacctgggctagaatgggctggctgggctgggctgaactgagctgggctgagctggactgggctggatagggctgagctgagctaaactgcactgagctgagctggactgggctgggctgaactgagctgggctgggctgggctgggctaaactgggcaggctgagctgaactgggttgagctgggctgagctgagctgagctgagctggtctgagctatgctgaactgggctgggctggattgggctggctgggctaggctgaactgagctgggcagaactgggctgggctggattgggctggctgacctgggctagaatgggctggctgggctgggctgaactgagctgggctgagctggactgggctggatagggctgagctgagctaaactgcactgagctgagctggactgggctgggctgaactgagctgggctgggctgggctgggctgggctgggctaaactgggcaggctgagctgaactgggttgagctgggctgagctgagctgagctgggctgagctgggctgggctgagctgagctgggatggactgagctgagctgaactgagctgagctaagcaggactaggctggactgggctggctgagctgggctggcctgagctgggcagagctgggctgggctggtcttgtctaggcctagctgagttgagctgggctgggctgggcggagttggcctgggctgggctgtcctggactgactgggtatactgaagtggactcatggggaggactgaggttgcctgggctgggctgggctggactcattgggtggactaagctgggctgcccttgcctttgataggctaggattgaccaagctgtctggaaccatggggatctgggcagagctgggcagagtgtagctgaggtgagtgagcggactgcactagcacgagccatacagatagcagggttcccctaagcccttggtgtgtggggtggactaagctcggcagatggagtgaggtccagcatccagcgaaggttaaaaaaagaagaagaaagctgagtgaatctgaggtaacctgactggatggctctggctgtgttcagcagggctgaattccactggcctgaacttgaccgggggtggctgaagggagccgggctgactggagcagctggctcaactgaggtggacccagctttagtcccatttctggactggttgagcagggctgggctatcttggactgtgctggactgggctgatctgggctcggctgagttgggctgcactgcactgggctgggctgagcaggactgggctgggcttacccttgttgaatgggttcccatgagtccattcgtctccactgcccttagccaaactgactggggccacgtaggctgtggcagagcagagcagtgaggacagagctgtgctgggcactgtggcattttaagagcccacagtagatcaagatcgtgtgcccagagtagatcaagatcgtgtgcccagagtagatccaagatcgtgtgccaagagtagatcaagatcgtgtgcccagagtagatccaagatcgtgtgccaagagtagatcaagatcgtgtgcccagagtagatccaagatcgtgtgccaagagtagatcaagatcgtgtgcccagagtagatccaagatcgtgtgccaagagtagatcaagatcgtgtgcccagagtagatccaagatcgtgtgcctagagtagatcaagatcgtgtgcccagagtaaatccaagatcgtgtgctctgggcactagggccaggactggctgggcatctgggccgtctgctcggagcaagcagactgccatgcacactggagcagctggggtgtcagggactgaggggtctgatggggtccctgtcctcccacccctgggagagcaccctggatgcccagcagtccagtgagggctgagctcaggagacaaagcctcagggagcagggccccccaagattgttgggggcaggaggggatggactggtggttcctggggtgcctgggctctgaaccgggcaagcgggcagccaggtgcctccactcctcaggagcccccgggctgtcctgggagcccggtctgagtcggcaactgcttgaagagggtgcgtgggctcatcaggagagaggtggaagccagggtgaggacagggccccctcagccagtggggtcctgggtctgacacaggccctgtcccctcagt

SEQ ID NO: 70 - DNA, 174 bp, Oryctolagus cuniculus
gtgagtgggacggcccagcggtcagcacacggcgggtgtccagatcacatccggctgagggggtggggagcgacagggcacgcccgatatgctctggccctgagcggggctgtgcagggggcagagggaggacccggcacggaggccactcacacccctgctctgcctagcgtg

SEQ ID NO: 71 - DNA, 96 bp, Oryctolagus cuniculus
caggtgtggaacccgtctgccctgacacccagaaagacagggctcagggaggaggggaggacggggtctcacacagcccccttcccacaccgcaga

SEQ ID NO: 72 - DNA, 80 bp, Oryctolagus cuniculus
gtgagccccaagctgtgggaggggtgggagcagggggcgggggcagggaggagcctgggctgacccagactgtccacagg

SEQ ID NO: 73 - DNA, 2189 bp, Oryctolagus cuniculus
cgcccactcccgccagggctccatgcagctggggcaggggaggagggctggccagccctgcctgctgcagggatgatactggcgagcaccccaataaacactgcagtgtcactcggagccctgggtgcccgttcttggggtgagcatctcagcaccaaagcgcagaccccgagaagaggcctgggaggcaggcagacagagcacactcctccaccagcttcacatcctaggcctttgtccaaaagcagtacaggggctcacacagcctccccgggcacgcccacagaggtgcacagagccaggccagggacagccaagccggcccggcccagaggtccaggcctccatcctctgggcaggtggccctggcgcccccaggtgcagaagcaggtggcaagttcctgtccatgcagaggtttgctgggcacctgtctgcacatgagcggagtacagggccagcagggctgagcccactcagcccacacagccacactgcaggctgggctggtggctagggtcccccattttgctgccctgcctccctctagccagaggcccctggagcagtcagcacccggccctaaagcccctaacagcactgcacacactcagggaccccacacacagccacctaggaccgctctagcccaggtcaccccacgtcccaggaggcctcacacctgactgggagcccagtgctccccacatgacctcctcctgtggccccagcccctcctggtcagttgtgatccatgggcagacatggacacacgtgcacagagacacacattgcccagcacagatgcgtgtgcacacacacaggtgcacccacacacacccattccactcttcactgagcacaagtccagagctggttgtgtggagaggctcaccctgggcctggaggctgggggctcagggccgggccgcctctcagccgcacctccacacacaggagccagcacgccccgcccaccccccatacagggaaagcacaggcctcgggctccaggctgcacacacacccccaactagaggagaagcggcacacaccacatccagccagaaccgccaccctgagccaggctcaccctcgcctcccagccagcactggccctggccctgggctggggacacagaggagggccatggccggcctgagccaccggggaccaggcgtgagcggcagaacccaggggaggaggaacagggtaccgggacggtggggtggccagctccgagggagggccagctctgggccccaagtgcacaaggccaggacggtccctcagaggcctacgatcactgggcaaagcctcctggcctgggcagggtggtctctgtgtgcacttggaagggccctgaactggcgggaccaggctgggcagggtgagccaggtcctggacggagggcaccctgatgaggtgccgtgaacaggtatgctggccagggccgaggcaagacaggtctgtagaggggcttcagggctgaggggaggtgaccagcagtcaggagaggaatcatgagaaatggaaggaaagaaaatgctggggccggcgccacggctcactaggctaatcctccgcctgcagcgccaacaccctgggttctagttccgatcggggcaccggattctgtctcggttgcaccttttctagtccagctctctgctctggcccgggaaagcagtggaggatggcccaagtgcttgggccctgcacccgcgtgggagaccaggaggaagcacctggctcctggcttcggatcggcgcagcacaccatagcggccattggggagtgaaccaacggcaaaggaagacctttctctctgtctctctctctctcactgtctaactctgcctggaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaaatgctggacccccaaggccacgagaggtcagcctggccctgcccacccaggggcaggagaaagcagagaaccaggacttctccccccaagccactggcaactcagagcaaccttctctggctggcctgtggctctgggcagcccctgggagggccacacggggagggtgatgggcagggctgactgaccgcggggtccctc

SEQ ID NO: 74 - DNA, 2420 bp, Oryctolagus cuniculus
cgcccactcccgccagggctccatgcagctggggcaggggaggagggctggccagccctgcctgctgcagggatgatactggcgagcaccccaataaacactgcagtgtcactcggagccctgggtgcccgttcttggggtgagcatctcagcaccaaagcgcagaccccgagaagaggcctgggaggcaggcagacagagcacactcctccaccagcttcacatcctaggcctttgtccaaaagcagtacaggggctcacacagcctccccgggcacgcccacagaggtgcacagagccaggccagggacagccaagccggcccggcccagaggtccaggcctccatcctctgggcaggtggccctggcgcccccaggtgcagaagcaggtggcaagttcctgtccatgcagaggtttgctgggcacctgtctgcacatgagcggagtacagggccagcagggctgagcccactcagcccacacagccacactgcaggctgggctggtggctagggtcccccattttgctgccctgcctccctctagccagaggcccctggagcagtcagcacccggccctaaagcccctaacagcactgcacacactcagggaccccacacacagccacctaggaccgctctagcccaggtcaccccacgtcccaggaggcctcacacctgactgggagcccagtgctccccacatgacctcctcctgtggccccagcccctcctggtcagttgtgatccatgggcagacatggacacacgtgcacagagacacacattgcccagcacagatgcgtgtgcacacacacaggtgcacccacacacacccattccactcttcactgagcacaagtccagagctggttgtgtggagaggctcaccctgggcctggaggctgggggctcagggccgggccgcctctcagccgcacctccacacacaggagccagcacgccccgcccaccccccatacagggaaagcacaggcctcgggctccaggctgcacacacacccccaactagaggagaagcggcacacaccacatccagccagaaccgccaccctgagccaggctcaccctcgcctcccagccagcactggccctggccctgggctggggacacagaggagggccatggccggcctgagccaccggggaccaggcgtgagcggcagaacccaggggaggaggaacagggtaccgggacggtggggtggccagctccgagggagggccagctctgggccccaagtgcacaaggccaggacggtccctcagaggcctacgatcactgggcaaagcctcctggcctgggcagggtggtctctgtgtgcacttggaagggccctgaactggcgggaccaggctgggcagggtgagccaggtcctggacggagggcaccctgatgaggtgccgtgaacaggtatgctggccagggccgaggcaagacaggtctgtagaggggcttcagggctgaggggaggtgaccagcagtcaggagaggaatcatgagaaatggaaggaaagaaaatgctggggccggcgccacggctcactaggctaatcctccgcctgcagcgccaacaccctgggttctagttccgatcggggcaccggattctgtctcggttgcaccttttctagtccagctctctgctctggcccgggaaagcagtggaggatggcccaagtgcttgggccctgcacccgcgtgggagaccaggaggaagcacctggctcctggcttcggatcggcgcagcacaccatagcggccattggggagtgaaccaacggcaaaggaagacctttctctctgtctctctctctctcactgtctaactctgcctggaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaaatgctggacccccaaggccacgagaggtcagcctggccctgcccacccaggggcaggagaaagcagagaaccaggacttctccccccaagccactggcaactcagagcaaccttctctggctggcctgtggctctgggcagcccctgggagggccacacggggagggtgatgggcagggctgactgaccgcggggtccctcagagctggacgtccaggacctgtgcacagagggggctgagcacgaggagctagacggactgtggaccagcacctgcatcttcgccggcctcttcctgctcagtacgagctgcagcgccaccgtcctgctcctcaaggtgggcgtgcacttgaggcccacaccccgtgccagggggcagcagggaggccggactgggccacagagctggcctcatgctgccctccctacagg

SEQ ID NO: 75 - DNA, 15187 bp, Oryctolagus cuniculus
cgcccactcccgccagggctccatgcagctggggcaggggaggagggctggccagccctgcctgctgcagggatgatactggcgagcaccccaataaacactgcagtgtcactcggagccctgggtgcccgttcttggggtgagcatctcagcaccaaagcgcagaccccgagaagaggcctgggaggcaggcagacagagcacactcctccaccagcttcacatcctaggcctttgtccaaaagcagtacaggggctcacacagcctccccgggcacgcccacagaggtgcacagagccaggccagggacagccaagccggcccggcccagaggtccaggcctccatcctctgggcaggtggccctggcgcccccaggtgcagaagcaggtggcaagttcctgtccatgcagaggtttgctgggcacctgtctgcacatgagcggagtacagggccagcagggctgagcccactcagcccacacagccacactgcaggctgggctggtggctagggtcccccattttgctgccctgcctccctctagccagaggcccctggagcagtcagcacccggccctaaagcccctaacagcactgcacacactcagggaccccacacacagccacctaggaccgctctagcccaggtcaccccacgtcccaggaggcctcacacctgactgggagcccagtgctccccacatgacctcctcctgtggccccagcccctcctggtcagttgtgatccatgggcagacatggacacacgtgcacagagacacacattgcccagcacagatgcgtgtgcacacacacaggtgcacccacacacacccattccactcttcactgagcacaagtccagagctggttgtgtggagaggctcaccctgggcctggaggctgggggctcagggccgggccgcctctcagccgcacctccacacacaggagccagcacgccccgcccaccccccatacagggaaagcacaggcctcgggctccaggctgcacacacacccccaactagaggagaagcggcacacaccacatccagccagaaccgccaccctgagccaggctcaccctcgcctcccagccagcactggccctggccctgggctggggacacagaggagggccatggccggcctgagccaccggggaccaggcgtgagcggcagaacccaggggaggaggaacagggtaccgggacggtggggtggccagctccgagggagggccagctctgggccccaagtgcacaaggccaggacggtccctcagaggcctacgatcactgggcaaagcctcctggcctgggcagggtggtctctgtgtgcacttggaagggccctgaactggcgggaccaggctgggcagggtgagccaggtcctggacggagggcaccctgatgaggtgccgtgaacaggtatgctggccagggccgaggcaagacaggtctgtagaggggcttcagggctgaggggaggtgaccagcagtcaggagaggaatcatgagaaatggaaggaaagaaaatgctggggccggcgccacggctcactaggctaatcctccgcctgcagcgccaacaccctgggttctagttccgatcggggcaccggattctgtctcggttgcaccttttctagtccagctctctgctctggcccgggaaagcagtggaggatggcccaagtgcttgggccctgcacccgcgtgggagaccaggaggaagcacctggctcctggcttcggatcggcgcagcacaccatagcggccattggggagtgaaccaacggcaaaggaagacctttctctctgtctctctctctctcactgtctaactctgcctggaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaaatgctggacccccaaggccacgagaggtcagcctggccctgcccacccaggggcaggagaaagcagagaaccaggacttctccccccaagccactggcaactcagagcaaccttctctggctggcctgtggctctgggcagcccctgggagggccacacggggagggtgatgggcagggctgactgaccgcggggtccctcagagctggacgtccaggacctgtgcacagagggggctgagcacgaggagctagacggactgtggaccagcacctgcatcttcgccggcctcttcctgctcagtacgagctgcagcgccaccgtcctgctcctcaaggtgggcgtgcacttgaggcccacaccccgtgccagggggcagcagggaggccggactgggccacagagctggcctcatgctgccctccctacaggtgaagtgggtcttcacagcggtgctgcgggagtcgccccaagcctcccacgactacaccaacgtcctccagctgcgggcctaggccaggaccacagcctgccgggcaggcctggcctcagctcccacggctgcccagcaacaggagggaagcagagagacccccgtccaccgatggcaagtggcactgagccctcccgccaactgcagcccagcaccaggactgaggcacaggagggaagagacggccccagccccagcccagtgtagcttccgtcccttcacagcgggtcctgggctccccacaggcctgtgggctcagggtcacccctgcccagcccatcgcctgcctgccccaggtccagcgccttgcagtctgccctgtgcctggctcccacccgccctgtagccccctgggcctccctgctccctaaccaccctgtctgcctcccttcttggtaaagctcctcctccctacagccccaagtctcccgagtgtgctttgagggtgtctgtggctgcagcggggtggagggtgtgggcaaggaccctgtgagagcctccagctcagcccccaccacgccggctggtctccagcccagcgccacgccccctactgaactgtgggcaaagccagggggcacaggaagtctcaggctgcaaatcaccaggtgggggctgccaagcagtctccccaggccaccagtctcccgtctacctctgagcacagctggacaatccctgccccagcagtcggcccaggctgtcagatgagcacccacaggcacctagaggcactggccagcccagactttggcaggctccccaggttggcttccgtgggggctctaggaagcccggtaaacacggggaaaactggtgagcaagggtgacagaggcctggggtcccccgggaaggagaggtgggcactgagccctgagccgctaggaccaggccaagttctggtgccccctgcccaagtacccgtcaccacagagcccactgatgccatggccctgggggacagttttacactgtcagggcccctgatgtgctgtcacacagactggggtctccagtgtgccaggccctgtcctcccaccggggccaaagtccaggagtgacagatgcccactagggacagaaaacccagaagtgagcaccggaccaaggatgccaggagtctggactacacacagcttcagagaggtgtgcaaccctctcgggacacacccagctcccacacgggccctcgcacacttagatgatcagaaacacacatgtactctcacagacaagggcacacacaagtgcaaggacacacactcacacccacacacgcagtcagaagcacacaggtggcctagtgggttaaatcaccacctgcagttcgacctcccatatgggctctggttccatccctggctgctccacttcctatccagctccctgctaatgagcctaggaaagcatcagaaaatggtccacgtgcttgggcccctgcaacacattggagacccgggagaagctctggctcctggctttggtctggtccagctcaagctgcttcagccatctgggcagtgaaccagcagatggaagacctctctctccgtaactctgcctctcaaatgaaataaatattaaaaaaacagtcagactctcagacatgctcacacacacacacacatacactctgacacacccgacccacagtcagaaacacacacactgtagggcacacacacacatgcacacacaaacagacacacatagtgagaaacacactgacactctcacacactcacacacacatgctaggatgcacactcacacagagacacgctgtcagacacacacatgcacacagaaacagtcacacgcatggacacactgtgagaaacacgctctcagacacacacacatgctagcatgcacactcacagacacgctgtcagacacacgcatgcacagaaacagacacacacacggacacactgtgagaaacacactgacactcttgcacacacacacacacatgctaggatgcacactcacacacagaaacacgctgtcagacacacacatgcacacagtcacacgcatggacacacagtgagaaacacactctcagacacacacacatgctagcatgcacactcacagacatgctgtcagacacacgcatgcacagaaacagtcacacgcatggacacactgtgagaaacacgctgacactctcgcacactcacacacacatgctaggatgcacactcacacacagaaacacgctgtcagacacacacatgcacacagtcacacgcatggacacacagtgagaaacacactctcagacacacacacatgctaggatgcacactcacacagagacacgctgtcagacacacacatgcacacagtcacatgcatggacacacagtgagaaacacactctcagacacacacatgctagcatgcacactcacagacacgctgtcagacacacacatgcacacagaaacaatcacacgcatggacacacagtgagaaacacactctcagacacacacatgctagcatgcacactcacacagagacacgctgtcagacacacgcatgcacacagaaacagacacacacggacacactgtgagaaacacgctgacactctcgcacactcacacacagacacacttttggacctgctcactcccactttgcagccgaggcccaggctcctcctcccatccctgcaggcagagctggggcttcttgctgtgacccacagagaccagcagccccctcacacggcctgggcaccacgctgaggggcagcagagccgcgccatcctggagagtactgcagggacacctccagcagccactcaagggcccgggccggggcacgaggacagcgtcagagccctacccctgctgtccgctcttattaatgtgccacagggtccctggcagctcccaagggcacatccacatcccggaccctgaggcccacagtctcgcagggtaacatcaacaggcgccgagagggtgatggccaagagccagctggcccgctgcacccagcctggggtttcagcagaggggccacgagaaccgagacctggcttcgctgacaaccagggacactgggctcgggccactgcagacgggccagccctgtacggacaaggaatggaagctgcaggacccagcccagccagagctgagcacacagcacggtgctgagcctccagcaggacctgcctccagccccacctcctaaacccagcccctcccccaccacagctgcaggaggccggcccactgcttcccagggaggctgttgttgagggctcctcctgcccatgggccccgtcctccacacacaggaatgagctcaggacgcccactgcggctgaggcccctgcgacaccctcacagcccaacccctagctcccatggaagtccagagcacagaggccataagggctgacccctctgccctccccatccccactctggggttctgggacccagaggaggggtctcaggcacaggtgtccaggagacccagcctgcgaggagctggcacggagcctccccacagacggacaacaggctccatgggacctcaaatgctgctgccagagcccaagagctaggatttcaaactcgggggaaacggaaggaaggaggcagtgcggagaaagagagaaatgtgcaaggggcagggagtccggcctggctggagcagctccaaggcctgtccacctgggctcctgctgggccaccgacccgccatggaaaccacggggctgcgatggctcccgggtctccctcgcttcctgaggctgcccagtccctctcctgccgcaccagcaccagtcctgagggctcaggggagctgtcccggccagcgagccggggacacagccaccatggtgtgagttctccgagtgtggagtccacgtctctggggtcacggcccagacaaaccccgagcagatgagactgtctttgttctacactggcctgctttggtcccagacacaaggccaccagacgacgcccggggaacagtgtccagcctcaggctgcggccgctccagaccactccccgccctgcgtcctgggtcttggcaaagcccaggcagggacaggtgtgcagcacagcaggtgaagctgcctcgggacacccacagcccacgtgggagcacctggggtcacggcctggctcagcctccgattccagtttcctgctgacctgcacctgggaagcagcagtgaccactccactcctgggccctgccacccacaagccagacccaggctcctggcttccgcctgcccagtcccggctcttgtgggcctcggggagccaaccagcagatggaagatcttcctctctctcttcttccctctctgccgccctcctgtgaggacagacgaaaacaaacaaggccagcagttgtgggagagcccctgtccccgccagggctggcgcctgcgctctcgtggcagtgctggccgccagggagctgttccctgtggaggacagcccaactgtgtcactcggcaaaccctgatcccaccgggcgctgtcggggtcaccagggtgcagcccacagtgggatccctgccttaggaaaagcacccagcgtgacctggctcctctccctgccaggggacggcacctgcagtgatcttcctctgtgcagatgagggcacccaggtgagctcgctctccctctctctctctctctccctccctctctctctctctctctctctccctctctctccctctctccctctctctctctctctctctccctctctctctctctctccctcctctggcttcctccctctccccccacccaaggtgtggacactgggagaagaccccgccctgacgctggctccagcctgcagaacggggagaatcggtgccttctctgaagcctgcccgtctgcactgtgtttgctgcagccgtcagcaatgcctaagacgcacgaccacgaggtccccgcactgagagtgcggccgtcacaacacctgccgagctccctgtggccaggccagggcacatctgccgggaccccgggccacgccacttctagcctggagctcccactgcccactgcagctcccaggctcaccatgctgcctcttgtgaccagagggcttcaggtcacccacacttcacaagacactgctgggcctgcctctgggtagaccccaggccccagcccagccaacccagccctgtggagctgggcaggtgtgtgcagcccctgctgcctcacctgccgctccccgctcccctcccgaccgggtgctccctggatgaggacaggtgggtacctgtgtatggctgcagaacctggtacagcaatgctgatggggcagcctggagagagatagggtgggggactggggtggatgcagggagccagggccaggaagagcctcaccctctgccagtcacaggccagagaccctgagaaggcagacctggaactgcagggggcttcagtcagctgtctgtgggactggacaggtacaggggtgcctggcccatggcacaatggctgtccccaccctgacatcaaccctgtggccctaaagacagccctgtcccctgggccctggccctcccatgaacgggactttctctcggcctgggctagcactccctgctctctgtctcccttcctgtacagtgtctctgagcttctgtgtccatttgggcctctccttcctgaatctcagcccccaccccagtcctgtggccggccacatggagccctcatctctcacggcccctggggtcccagggcccaggccacacacacctgtccccaccacagacagaccacagaccagacatgacgtggagacgagctgcactgtctgctgggacaggaagtggtgagtgaccccaacgtggggccagacccacagtcacgcagcctccccagcctgcactcagcagccagccccagcccagccatggacaaagagccaagcaggtgcacatctctccaggagggcccggaccaggcctggctcccactccactcggcccctctgggccaggagcacagggtgcagatgaggagctcaggcccaggcatggacctgcagtgcagggcagcctggccagggagacctgaccctccatggtgctcctccagcagcccagacaggtgagtccacgggactctgcccctctgcactggggcagtcacagccaggctggtcctgaggctcctgggggcagagggagaacaggcatcagccaaagagggcagggagatggggaccacggccaggagcccagccagtgtcagctcagtaggctgaatccagcagagcccaactcaggatgagctgagtccctgggaggcagtgccaagagccctgcaggctgatctagatgtgggctgtgcagggacagagaggagcagatgatgatgtggggaaactgatgaatgcccaccccatgatgaactgggctgagttgtgctgagctaggatgacttgggctgggctacgctgatctgggcagagctgagctgaacttggctggactgactagagctgacctgggaagaactggactgaacttgaatgagctgggctcagctgtggtggaccaggctgggcagagctgggctggaatggtttgagttgagctaagctgagctgagttgagctgggcagaactgggcagagctgggctgagctgggcttggctaggctgagctgggctgtgctgagctgagtgggctgagctggcctgaattgggctgagctgagctgggctgggcagagctgagctgggctgggctgagctgagtgggctgagctggcctgagctgggttgagctgggctgagctgtgctgagctgagctgagctgggctgggcagagctgagctgggctgggctgagctgggctgagctgagctgggctgggctgagctgggctgagctgggcttagctgggctgagctgcgctgggctgagctgagctgggctgagctgggctgatctgggcttagctgggctgggcaaagctgagctgagctgggctgggcagagctgggctgagctgtgcttagctgagctgagctgggctgggctgggctgggctgagctgggctgagctgagctgggctgagctgggctgggcagagctgggctgggctgagctgagctgggctgagctgggctgagctgggctttgttgggctgggcagggctgagctgagctgggctgagctggactgggctgggctgagctgggctgagctaggctgggctgggctgagctgagctggactgagctggactgggctgggctgagctgatctgggctgagctagagtgggctgagctgagctaggctgggctgggcagagctgggctgagctggggtgagctggtctgagttgggcttgcttggcagagctgggctgggctgggctgagctgggctgagctgggctgggctgggctgagctgggcagagctaggctgagctggtctgagctaggcagagctgggctgggctgagctgggctgagctgggctgagctgggcagagctgggctgagctgggctggcctggctggacagagctgggctgggctgggcttggctgggcagagctgggctgggctgggctgagcagggctgagcctggcagagctgagctaggctgggctgagctgatctgggctgagctagagtgggctgagctgagctgggcttggctgggcagagctgggctgagctgggcagagctgggctgagctgggctggcctgggctggacagagctgggctgggctgggctgggctgggcagagctgggctgggctgggctgagcagggctgagcctggcagagctgagctaggctgggctgagctgagctgggcagagctggggtgagcagggctgagctgggctgagcagggctgagctgggctgagctgggcagagctgggctgggctgggctgggctgggctgggctgagcttaactggactgtgctgaactgagcttggctgagctgggctctgctgagctgagctgggctgatctgtgctgggctgggctgagggctgggcagagctgggctgatctgtgctgggctgggctgagctgggctgggctgggcagagctgggctgggctgagctgggctgagcttaactggactgtgctgaactgagcttggctgagctgggctctgctgagctgagctggggtgagctgggctgagctgagggctgggcagagctggactgagctgggcttggctgggctgagctgggctgtgctgagctgagtgggctgagctggcctgaattgggctgagctggcctgggttgagctgagctaggctgggctgggctgagctgggctgagctgagctgagctgggctgagctgagctgagctgggctgggctgagctgggttaagctgggctgggctgggcttagctgggcagagctgagctgtgctgagctaggctgggctgagctgagcttggctgagctgggcttagctaggcagagctgggctgggctgggctaggcagagctgggctggactgggctgggctgggctgggctgagctgggctgagctgggctgagctgggctgatctgggcttagctgggctgagtgggctgatctgggcttagctgggctgagctggcctgggttgagctgagctaggctgggctgggctgagctgggttgagctgagctcggttgagctggactgagctgagctgagctgggctgggctgggctgagctgggctgggctgagctgagctgggctgagctgggctgagctgggctgagctgggctgagctgggctttgttgggctgggcagagctgagctgagctgggatgggctgagctgagctgggctgagctggactgggctgggctgagctgggctgagctaggctgggctgggctgagctgagctggactgagctggactgggctgggctgagctgatctgggctgagctagagtgggctgagctgagctgggcttggctgggcagagctgggctgagctggggtgagctggtctgagttgggcttgcttggcagagctgggctgggctgggctgagctgggctgagctgggctgggctgggctgagctgagcagagctaggctgagctgagctgagctaggcagagctggactgggctgagctggtctgagctgggctgagctgggctgggctgggctgagctgagcagagctaggctgagctgagctgagctaggcagagctggactgggctgagctggtctgagctgggctgagctgggcagagctgggctgagctgggctggcctggctggacagagctgggctgggctgggctgggctgggcagagctgggctgggctgggctgagcagggctgagcctggcagagctgagctaggctgggctgagctgagctgggcagagctggggtgagcagggctgagctgggctgagctgggctgagcagggctgtgctgggctgagctgggcagagctgggctgggctgggctgggctgggctgagcttaactggactgtgctgaactgagcttggctgagctgggctctgctgagctgagctggggtgagctgggctgggctgagggctgggcagagctgggctgatctgtgctgggctgggctgagctgggctgggctgggcagagctgggctgagcagggctgagctgggctgagctgggcagagctgggctgggctgagctgggttaagctgggctgggctgggcttagctgggcagagctgagctgtgctgagctaggctgcgctgagctgagcttggctgagctgggcttagctaggcagagctgggctgggctgggctgagctgggctgagctgagcttggctgagctgggcttagctaggcagagctgggctgtgctgagctaggctgcgctgagctgagcttggctgagctgggcttagctaggcagagctgggctgtgctgagctaggctgcgctgagctgagcttggctgagctgggcttagctgggcagagctgagctgtgctgagctaggctgcgctgagctgagcttggctgagctgggcttagctaggcagagctgggctgtgctgagctgagtgggctgagctggcctgatctgggcttagctgggctgagctggcctggtttgagctgagctaggctgggctgggctggcctgggttgagctgagttgggctgggcagagctgggcatagctgacctgggctgagctgggctgggctgagttgggctgagctgggcttagctgggttgagctgggctgagctgggctgagctgagctgagcagagctgggctgggctgagctgagcagagcttggctgggctgggcatgctgagctaggctgggctgagctgagctgggctgagctgggcttagctaggcagagctgggctgagctgggctgagctgggctgtgctgagctgagctaggcagagctgggctgggctgggctcggctgagctgggttgagctgggctgagctgggctgggctgagctgagctaggcagagctgggctgggctgagatggtctgagctgggctgagctgggctgagcttggctgagctggactgggctgagctgagctgggcagagctgggctgggctgagctggctgagctgggctgagctgggctgagctgggctgggctgagctgagctaggcagagctgggctgagctgagctggtctgagctgggctcagctgggcagagctgggctgagctgtgctggcctgggctggacagagctgggctgggctgggcagagctgacctgggctgggctgagcagggctgagctgggcagagctgagctgggctgggctgagctgagctgggcagagctgggctgagcagggcgtagctgggctgggctgggctgagcagggctgagctgggctgagctgggcagagctgggctgggctgagctgggctgagcttaactggactgtgctgaactgagcttggctgagctgggctctgctgagctgggcggatctgcgctgggctaggctgagctgggctgggctgagctgggctgtgatgacctcatcttggctgagttgagctgatctggcctgacttgggctgtcatgggctacattaagctgggcagagctgggcagagctgggctgagctgagctgggctgagctgggctgagctgggcagagctgggcagagctgggctgggctgagctggactgatctgggctgaactgatgtgttgtgacctgagctagacttagctgattaggaatgggctggattgaactgggcagagctgggtagagctaggcagagctgacctggcagagttgggctgacctggactaagctgacctgggctaagctgaactaacctgggctgtgttgggctttattgacctttactgacctgggctgggctgagctgggttggactgggctaagctgagctggcctgaggtgaaataagctgaactggcctagcttagctcacctggtctgggctgggctgggctggattgggctgagctgggatgacctgagctgaccagggctggactgagctgagcttatgtagactgagctgacctggattggactgggctgagctggactgagctgactgggcttagctgggctgagttgggctaaggtgacctgagctaggctgagctggactaagttgacctgggcagagcagaggtgacctgggctaggctgaactgacaactgacctaggctgggctgtgctgggcagaactgaactgaactgggttgagctgggctgacctgtgctaaactaagctgatcagggctgagttgaactgggctgggctgggctggactggactggttgagatgaacagtgtcttctggactctggaaacttccaaatatgtgtctgaggttgagctactttttgaggtactgggatttctggaatgacttaggtcaagcccagagcccatggtgcagccaggcagggcctgtgttcctagggcggagcctgtgcctctgggcgctgtcggtcacctctgtcctgcaggactcagagatgtcctgggcaggaggctgccatgtggtcagagctccaggaacaagcgctccttggcattgggagccctggtggccaggagggctggtgactactgcttcatggggggaggggtgtgagtgtgggggccgtggggccgggggccgtggggccggggcaagagtctaggatcctggtaatggaagtgctaggaggggacagagctggatggaccctctgcctccccatggccttcaccaagcccagattgctccggcccggccagccccttctctccaaccaacccttcagcacccaacctgtgcacactgccctaatcagcctaaggccctgggagcctggggccctcgacggctccgtgccagccaagcttgaccagctcagccccaaggagcctgggagacacagggcagcaggagtcagctggacacttctggccccagtcctgtgcagctgctgtgaccctgggctgctctcctcccctctctgggccaggttccggctgggatgatgcaggcaggaccctgtgctccaaaggtgctctggggtagcagtctcgtggctgcaaaagtctcacagtgtgtcctgtattgcagt

SEQ ID NO: 76 - DNA, 137 bp, Oryctolagus cuniculus
gtcagagggcagctgggggcagcgggcatgaggctgcagagtgggctgcgggctggaccattaagctggggcagaggacagcccacacagggattaaagaaagggtactgaaacaaggtcttctctgttccatcagc

SEQ ID NO: 77 - DNA, 184 bp, Oryctolagus cuniculus
gtgggcctgcccccacccccgggaaatgggatgctctcctcacccccacccccgactcctcactcccttcctgggctctgagactcccaccctggaaaatagagggaaactcaagctagccatcaggacaaggggctcggtcctcccctgccaccctgatcccgctctccccattccaggcagc

SEQ ID NO: 78 - DNA, 2128 bp, Oryctolagus cuniculus
gcccctggcctgccctgaataaattccgtgctcgcccccagcagccctgcgggttcattgtgccagtctgtctcctcgggggctgcagccacatggcggggagggggagcgcccctggtcctaggagctggggcttgggcacctgaagggacaccatgcatggtgaacgtgagtgtgcatgtgagcgtgagtgtgagcaaacatgcctgtgagaaatagtgtgcctggaagtgagtgggtctgggaatgtgtgtgtctgggaatgagtgtgtctgggagtgagagtacctgggagtgagcatgaatggaagtgagtgtgcctgggagtgagtgtgcctgtctgggagtgagcatgtctgggagtaagtgtgtctgggagtgagtgtgtctgggagtgagtgtgtctgggagggaacagtgagaggggaggctgagccggggtggattctgaggcagtgcaggcatagctcaggttgcacccagagccgtggacaccagcaggagttcctgggcggcagggatgcagccattgccctggtgcagaggacgagggagggagggggaggaacagggggcgtgcagggacccctgggacaaggtgtccacaggccccacagcccagcaggggtggacagtgcaggacagcgctgacacacacagggcacacagcaggccccaccccgcaccacgctctctggagcctgcacacggcacacgtgctcacagggcacacacgctcacacacgtccccctcagctgcaggggagctcacagtccagacccagctccaggaaggcaggggcatccccacccgaccccagacggtttccccaggcccagccctgctgcccatggccctgctggccctctctgggcctccctgaatgtccagccatgcacagctcagggaccagttccactgcccaccctaggcaggccctgctcactgctgggtcccagactcaaccctccaatcctctcctgagcccgagtctgagccaaaccacaggcagagaggggctgagcagagaccaccgacacaggcccctcctcagacgtcgggcttctgattcacaccccaggaaccccagtacagtcacagaccagtgtaggaaccccaggcaccaggactcccacagggcaccgggcccctgctgctgtctcaattgtccttggggcctcccaagggctctggctctggccacctcccttgtcagggcccaggtgaagaggagccccacacacagcgatttctctccccagggatgcccggcccaaggagctgtagggggaggaacaggccaggcagggaaatggtacccacacaagtgccccagccaccccatggggcccaggaactgagccaaaggagcagcttgctaagaaagagggaaaggggagaattaacatagagagcagacagattagcccatgagcctaagacagtggaacatggatggatgggtggacggtgggtggatggatggaaagatggtagatgtatcagtggatggatgcatgacagctatatagatgggaagaacagtggatggatagataaataattgatagatgacagatagatgaattagagatttgattgatgcaccagtacagggcaaaaaggatcaactccaaataacacagatccatcacccaggacctgggacgtccggtgcactctgctggctgctcgctgctggccttcgctggccgtccctcagccacttccctggggaagaacagaggctctgctcacaccaaggtccctgctcacgccctgggcacactgaccccacactcagaccttgaggtgtgcctggtcctctctggacccaggtcccggccaaggccagcccaagagcagggcttaggcaggagccactgacacgtggctcagctcaggccagcagggctccggccacaccttccctggaccagcaaggacactgccccgcctcctgtcctgcagctgcgctaagacacttgtaggggccaaccccctatgggccctgctctcgccctcagaccccatagagaccccaccactccacccccagcccctgagaaggcgtgtgagggaaggcctggggcccaggccccacccacacattcacgtcctggcagg

SEQ ID NO: 79 - DNA, 16349 bp, Oryctolagus cuniculus
gcccctggcctgccctgaataaattccgtgctcgcccccagcagccctgcgggttcattgtgccagtctgtctcctcgggggctgcagccacatggcggggagggggagcgcccctggtcctaggagctggggcttgggcacctgaagggacaccatgcatggtgaacgtgagtgtgcatgtgagcgtgagtgtgagcaaacatgcctgtgagaaatagtgtgcctggaagtgagtgggtctgggaatgtgtgtgtctgggaatgagtgtgtctgggagtgagagtacctgggagtgagcatgaatggaagtgagtgtgcctgggagtgagtgtgcctgtctgggagtgagcatgtctgggagtaagtgtgtctgggagtgagtgtgtctgggagtgagtgtgtctgggagggaacagtgagaggggaggctgagccggggtggattctgaggcagtgcaggcatagctcaggttgcacccagagccgtggacaccagcaggagttcctgggcggcagggatgcagccattgccctggtgcagaggacgagggagggagggggaggaacagggggcgtgcagggacccctgggacaaggtgtccacaggccccacagcccagcaggggtggacagtgcaggacagcgctgacacacacagggcacacagcaggccccaccccgcaccacgctctctggagcctgcacacggcacacgtgctcacagggcacacacgctcacacacgtccccctcagctgcaggggagctcacagtccagacccagctccaggaaggcaggggcatccccacccgaccccagacggtttccccaggcccagccctgctgcccatggccctgctggccctctctgggcctccctgaatgtccagccatgcacagctcagggaccagttccactgcccaccctaggcaggccctgctcactgctgggtcccagactcaaccctccaatcctctcctgagcccgagtctgagccaaaccacaggcagagaggggctgagcagagaccaccgacacaggcccctcctcagacgtcgggcttctgattcacaccccaggaaccccagtacagtcacagaccagtgtaggaaccccaggcaccaggactcccacagggcaccgggcccctgctgctgtctcaattgtccttggggcctcccaagggctctggctctggccacctcccttgtcagggcccaggtgaagaggagccccacacacagcgatttctctccccagggatgcccggcccaaggagctgtagggggaggaacaggccaggcagggaaatggtacccacacaagtgccccagccaccccatggggcccaggaactgagccaaaggagcagcttgctaagaaagagggaaaggggagaattaacatagagagcagacagattagcccatgagcctaagacagtggaacatggatggatgggtggacggtgggtggatggatggaaagatggtagatgtatcagtggatggatgcatgacagctatatagatgggaagaacagtggatggatagataaataattgatagatgacagatagatgaattagagatttgattgatgcaccagtacagggcaaaaaggatcaactccaaataacacagatccatcacccaggacctgggacgtccggtgcactctgctggctgctcgctgctggccttcgctggccgtccctcagccacttccctggggaagaacagaggctctgctcacaccaaggtccctgctcacgccctgggcacactgaccccacactcagaccttgaggtgtgcctggtcctctctggacccaggtcccggccaaggccagcccaagagcagggcttaggcaggagccactgacacgtggctcagctcaggccagcagggctccggccacaccttccctggaccagcaaggacactgccccgcctcctgtcctgcagctgcgctaagacacttgtaggggccaaccccctatgggccctgctctcgccctcagaccccatagagaccccaccactccacccccagcccctgagaaggcgtgtgagggaaggcctggggcccaggccccacccacacattcacgtcctggcaggccttctgtgtcttgcaggttgtcaggagcccctgccctgtgtggtgctggatctgccacaggacagcctggaggaggaggcccccggcgccaacctgtggcccaccaccgtcaccctcctcactctcttcctgctgagcctgttctacagcacagctctgaccatgacaaacatccgggacccacctggcagcaaagagggaccccagtactgaggcacaggtgtggggatgccctgggaagggggtccgggcccaaggacaggtgactgctgctgccatagaggggcacacgggtccctgcaggaactgggacatgggtgccctgggtcagggtgggagcgtccccgggtgcaggagctgaggattccaccaaggctcccgggagccaggccccgcctgggacaggggagagggtgaggacaccgcccaccctcagctgcccctgtctctgcaggagggaagcgtgcaagagcccctgggaaagccagctctgcatgccagagcccagccctccatgaagcagcggaccccctcatccccctgccaggtgcactcaacccttcccagacgaatgttctcgctctgctggacgatggctcagggaagccacggtggctgcagcctgggagacgcctgccactccaacacagggacttcagcatggactggacacggtgccccagacatggcctgaccctgcaggaggctcaagtccaagaccagtgcttcacctggagtgttcaggaggatgcctccttggaactggccatggaactggtcctgagcactggtccctggtcctggtcactgagccctggtcctcattactgagcccaggtcctatcatggagctctagtcctgaacactgggtctgtgtcctcataactaagccctggtctgtactttgggtcctcatcctgagtgctgtatcctggtccagactttggaacctggtcctgatctctgagccctggtcctgagtactgagccctggtgctcctcactgagccctactcctggacattcatccctggttctgctcactgggtcctggttctgctcagggtgcctaagttctgatcactgggccctggttctggtcactcagccctggtcctgggacctgctgctggtcctgaccctgtcactgattacagctccccgcccctgagttctggaccctgcgtttgcccactgctccctggggctactgctgagccctgcctcaggtcctgagttgggtcctgaacacaggcagtggccctggtcagtaacccaagctccaggtcactgcccctgtaactggtcagcgagctgaggtcagcttattcagtcctggtcccgagctcggggccactcctcagcactgattcctggtgccatccctggtccatagccctgagcccaggtcctgggaaccgcaccctgggagtgatcactgatccacactcagatcactcagcactgccggacccagttgatgacctggctcctgcttgcttaggcctagtcccagccaaggtagctttgggggagtgaatcaattgatggatgatctttctctctctctctctccctctacatgtgtcgttcacagcaactgcctttcaaataaatatgtcattaaaaattgagcacccggggccaacattgtggcagagttttgttcatgttcgttccaaactagctctctgttatgcagctgggagagcacagaggaggcccaaatgtctgggtccctgccacgcacgggagagacccagatgaagctcctggttcttggcttcagcctgacccatccctggccatcacagccatctgggcagtgaaccaaccacaggctctctggtctccctctctctgtctctgtaactctggctttcaaataaagaaacaaatcttttctaaaaataacaactccgcccccatcaggatgaaaccatgggaataattgggtctagaatgaacctagctgagcccagcagaggccactgggacagccacacagccagcgccgccccagctgagggaagcgggagcgagccctcagatctcaggggcaaaggcgtccactcgcgcaatctcagccacagggcgtgggagcttctgccgagatgcagcgagagaaagggcacaggtgcgcacacaggaagggagagttaagtgagccctgcaggagaaggcgctgcctccacacggagcgaagctgcaccaccaggcctcagggccacagccaaggaggctgtcacatgaggtcagcccctgtgtgcaccgctgaccacctggctgaggaaaacacagagagagccaccccattacaacatccgcctagaactggtcccggccccaggtccctgcccggaggaaacgaggtcagaggtcagggagaggcactgtccctgctcttggcagcattgcccccagtagcaaaagccaggactcgacctaggtgtgcccggacagagactgggcaaagaacaagtgcttcctgtgcaccacgaaacaccatcactacacacaccacaaaatactacacacataaacaccacaaaatatagcccggatggaccacgaaataccatacacatacactgtgaaataacatacacaagtacaccacgaaataccacacacacacacaacatgaaatactgctgacatgtaccatgtaataccacacacacatacaccacaaaatatagcccacctatacaccacgaaataccacacacacatacaccacaaaatatagcccacctatacgccacgaaataccacacacacgtacaacacgatgtacagcccacacatacaccatgaaatccacacacacagatgttcaccataaatacagcccacatcaacaggaagaactgtaaacaagtacaccctaaagtaccaccctctacactcagaaatatcatctccacgtacccctgaaaattcaccctaaattatcaaccacgtgtgcaccctgagacatccacctgtgcccccgaggcacccatctgtgcacccggaggctcgtggaccccgtgaagagccctcacctttcagagagggaaattcagtcttggccacaggtgcatgagcctggcggccaccgtgccctcaactgcacctggcccagaggagcacgcgctccgtggttctttgtcatgtgcaatctgagagctcagggcagtgccctgggagactggggcggggggggacacccagggtgagaacacagtgggacaggatccccaggcgctcaggcgcggctcagggggacagtgcactgcagggccctggagcacaccagccccaggtcagcgccagctcagccccggctgctccgcttcctccccagctccctgctctgcacctgggaagacggtgggtggtagctcagtgctcgggccctgcacccacgcaggagaagagagggagttctgggtgagccctctgcctctggggttctgtcaatcaccctgtcctgcaggactcagagacgtcctgggcaggaggctgcggtgttgtcagagctccaggaacaagcgctccttgggttttggagccctggtggccatgagggctgtcatccacctgccaggtgcagtcgacacttcccagacgaatgttctcactctgttggacgatggctcagggaagccacggtggctgcagcctgggagacgcctgccactccaacacagggacttcagcatggactggacgtggtgccccagacacagcctggccctgcaggagggctcaggaggaggcctccctgaagtggccttggaactggtcttgagcactgggccatggttctgagcactgagccctggttgagagctaagctttggtcctgatgaccgagtcctgttcctggttactgagccctagtcttgcaaactaagccctggtcctggtcaagatccctggtctgaataattgagccctggtccttatctgagccctggtcctattatctgattcctggtcttgatgactggatgtggtctggatattgggccctggtcatgacaactgagccctggtcctgctcactgggccctggtcatgtgtactatgcctttgtcctcatcactgatccctggtcctgctctctgaaccctggtcctgggccctggtcctgatgactgagccctggtcctgctctctgatccctggtccttagccctggtcctgagcctgggcctcgccccattgcacacaccaggactcctcctgagctgcatcctctaaggctctgactcctttgcacacatcctgagccctgagtgctgaccactctaggacgtgacctgcaggaaggccacagccctcagggaggccccggcgggcaccgcttgcagatgcagtcacggccgcactcctcatcctcactccgtcctctcaggccctgaggggttgcaggggtggagaggggacaagcccaggccccaggctgcctgaggtggactcagtgcctgcggtccccgggtcaggggtgcagcgcaggtgggaccgaggaggacggacggtcgtgttgttttcccctgtgttgctccttcttcagaagcttcctgtgcccgtgcacctgctgaaacccctgaaatagccctgggccggctgagtcatcccaggcacaacccaggtgtccccgctgagacccctgttctcaggccctccacggaggcctggccagattgccccgaggcctgggcaaggacggacagccccatggggaccttggggccctcccacccctcaggacagggtctcacggacaccacccaccagccccagccaggcttcaggaaggccaagagctcaggttagccaggaccagcctggcttctggcagggtcagcccaggctcccctgccttccaccaggtcaggccgtctcagccaggccgtctccctggggcactgacccacagcacagcagacccacggggacccgggctagtacctgccactgcacctcagcgtccccctgcccatgtcagggccgatgaagggcacagcctggccccgccccagcctttgcagccctctgggagggaaccagcacacacaagatctctctccttctctgtaattctgccttcaaataaataaatcagtgacaagtaaaacaaaagctgtgctggagcgagggcacctcacccctgctgagcgagcacagccccccccccagggcccacagccaaagccccgctctgctcagagcaccagctccagtgatctcaagtgatcccgggaaggatctcacggggacgccgctgtgggctgcgggtcaggggtcccggcaccccgtgggctccaggctgcaaccagcaagggaagggcagcagcacagcccccacccccacccccacaacatacgccactctgatggaagagtgaccgtgagcaaagccattaaacagagccgatctggaaaaattctgccccccccccagactggctcccactccctccctccgccatgggcaggcagtgctgagacccccaggacaggggcccagtgacccagcagggagacagcaaggcccactcctgcctcagggtccctcctagcatacagggactgaggcctgcccgggtccaccctgaggacatgggctgagcgaggccagcaggacccacctccaaccctaccatctgcccggggcccttcccccaccacagctgcaggaggccagcccactgcttcccagggaggctgtatctgagggctcctcccgcccatggaccccgtcctccacacacagggatgagctcaggacgcccactgcggctgacgactcggcaacaccgtcatagcacggccccttgctcccacggacgcccacggagtgcagaggccatccgggctgaccatttaccctgcaacaggcgctcagtggagctctggaagcctggaggagggtctcgggcacaggtgtccatgaagtgcagcctctgcagctgagacccagcctgcgaggagttagcacggagcctccccacaggaggagcgtccacgtctctggggtcacggcccagacaaaccccgagcagatgagactgtctttgttctacactggcctgctttggtcccagagcacaaggccaccagacgaggcccggggaacagtgtccagcctcgggctgcggccgccccagaccactccccgccctgcgtcctgggtcttggcaaagcccaggctgggggcaggcgtgtggcacagcaggtgaagttgcctcgggacacccgcagcacacatgggagcacctggggtcacggcctggctccgcctccaattccagtttcctgctgacctgcacctgggaagcagcagtgaccactccactcctgggccctgccacccacaagccagacccaggctcctggcttccgcctgcccagtcccagctcttgtgggccttggggagccaaccagcaggtggaagatcttcctctctctcttcctccctctctgccgccctcccgtgaggacagacgaaaacaaacgaggccagcagttgtgggagagcacctgtcccccaccagggcgggcgcctgtgctcccgtggcagagctggccgacgaggagctgttccctgtggaggacggcccaactgtgtcacccggcaaaccctgatcccaccgggcggtgtcgggggtcaccagggtgcagcccacagtgggatccctgccttaggaaaacacccagcgtgacctggctccaggggacggcacctgcagtgatcgccctctgtgcagatgaggactcccaggtgagctcgctctccctccctctccctctctccctctctctccctccctctctccctctctctctctccctctctctccctctccctctccctctcttcctccctcccccccacccaaggtgtggacactgggagaagaccccaccctgacgctggctccagcctgcagcactgggagaatcggtgcctcctctgaagcctgcccgtctacactgtgtttgctgcagccgtcagcaatgcctaagacgcacggccacgaggtccccacactgagagtgcggccgtcacaacacctgccgagctccctgtggccaggccagggcacatctgccgggaccaggggccacgccacaacctagcctgctgacctggcccctgcacctcccaggctcgccgtgctgcctcttgtggccagggggcttcaggtcacccacacttcacaagacactgccgggcccacctctgggaagcccccaggccccagccccgccaacccaggtcctgtggagctgagcaggtatgtgcagaccctaccagctcacctgccgctccccgctccccgacaaacccagacctccctgggtgaggacacgcgggtacctgagtgtggctacggaaccctaaggagagaagacatgggccagcaacactgacgggacagcaactaagacagggcagcctggagagagatggggtgggggactggggtggatgcagggagccagggccaggaagagcctcaccctctgccagtcacaggccagagaccccgagtgggagaaggcagagctggaactacagggggttcagtcagggatcccagctgtctatggggctgcactggcaggggtgctaggcccatggcacaatggctgtccccaccctgacatcagccctgtggtcccaaaggaaaccctgttccctgagccctggccctcccatgaatggggccttctctcagcctgggctagcactcccagctctccgtccccatcccagtcccagtgtctctgagactctgtgtccatttgggcctctccttcccgaatctcagcccccagccccgccctgtggccagccacatggagcactggtccctccagggtccctggggtcacaggacccaggccacacacacctgtccccaccacagacagaccacagaccagacatgacgtggaggcaagctgcactgtctactgggacaggaagtggacagctgagggaccccaacgtggggtcagacgcacagtcacgcagcctccccagcctgcactcagcagccagccccagcccagccatgggcaaagagccagagcaggtgcacagctctccaggagggcccggaccaggcctggctcccactccactcggcccctctgggccagcagcagagggagttgatggggagctctggcccagagtgtggacccgcagtgcagggcagcctggccagggagacctgaccctccatggtgctcctccagcagcccagacaggttggtccacgggattctgcccctctgcacaggggcagtcgcagccaggctgatcctgaggctcctggggacagagggagaacaggcatcagcacagagagcagggagggggagaccacggccaggagcccagcgaccacaggcaggacacagccactggccgggagaggctgggacagggggctgagcccggcagagcccaactcagtcaggatgagccgaggccctgggaggcagtgccaagagccctgcaggctgatctggacgtgggctgtgctgggacagagaggagcagaggaggacgtggggaacctgatggacgcccaccccctgctgggctgggctgggctggaataaaagggtaagttcgggctgagctgagctggactgagctgggctgggctgagctgagctgggctgggctgagctgggctgagctgggccgagatgggccgagctaggccgatatgggcagagctaggcagagctgagctgggtcgatctgggctgtgctgggctgagctgggctgcactgatttgagcacagccaaactgcactgcaataatgggctgggttgggctgggctgagctgggctgagctgggtgaaggtgacctgtgctgaccttggctggggtaggctgggctgagctgaccttggctttgatggactgagctgggctgggcctggctgggctaggctgggctgggctgagctgagttaagaagggctaagctgaccttggctgtagaggcatgagctactttgacttggatgggctgagcggggcaaagttgagctggactgaaatgagctgagctgggtggaggtgaccagtgctaacctgggctgggtttgggctggactgagctaggctgagctgggctgagctgggctgagctgggctgagctgaactgggctgggctgacctgggctgagctgggccaggccgacctgggctgggctgagctgggctgaaccaggctgatcagggctgagctgagctgggctttgatgggctgagctgagctgagctggcctgggctgacctgggctaggtgaccttggctatgctaggccgggccaagctgagctgggctgggctgggctgagctgagctgggctgagctgggctaagctgggctgagctgagctgggctgagctgggctgggctgagctgggctcggctgagctgggctgagctgagctgggctgagctgggctgaaccaggctgagctgggctgagctggctgggctgagctgggctgaaccaggctgagctgggctgagctgagctgagctgggctgagctgggctgagctgggctgggctggtctgagctgggctgagctgggctgagctgggctgagctgagctgggctgggctgagctgagctgggctgagctgggctgagctgagctgggctgagctgggctgagctgagctgggctgagctgggctgagctgggctgaaccaggctgacctgggctgagctgaccttggttttgatgggctgagctgggctgagctgggctgagctgggctgggctgagctgaccttggcttgatggactgagatgggatgagctaagctgggcagagctgggctgggctgacctgagctgagctgagctgggttgagctgggctgagctgggctaggctgggctcagctgggctgtctgggctgggctgacctgtgctgagctgggctgggctgagctgaccttggcttgatggactgagatggggtgagctaagctgggcagagctgggctgggctgacctgagctgagctgggctgggttgagctgggctgagctgggctaggctgggctcagctgggctgtctgggctgggctgacctgtgctgagctgggctgggctgagctgggctgagctgaccttggcttgatggactgagatggggtgagctaagctgggcagagctgggctgggctgacctgagctgggctgacctggcctgggctgagcagggctgagctgggctgggctgggctgggctgtgctgggctgagctgagctgaggtgggcttagctgggctgggctgggctgagctgggctgggctgggctgggctgggctgagctgggctgggctgggttgggcttggctgggtttggcttggctgagctgtgctaggcagggcagggctgggctgacctgagctgatctgggctgggttgagctgggctgggctgggctgggctgggttaggctgggctcaaatgggcagagctgggctgggttgagctgggctgggctgggctgggctaggctgagctaggctgggctcagctgggcagagctgggctgggttgagctgggctgagctgggttaggcttggctgagctgggctgaaccggactgaccagggctgagctgagctgggctttgatgggctgagctgagctgagctggcctgggctgacctgggctaggtgaccttggctatgctaggcagggccaagctgagctgggctgagctgggctgagctgggctgagctgagctggactgagctgggctgggctgacctgggctgagctgggctgggctgagctgggctgggctgacctgggctgggctgagctggactggtgtgagctggtctgagctgggctggtctgggctgggctcagctgagctgggctgagctgggctgtgctgggctgagctaggctgaaccaggctgagctggactggtgtgagctggtctgagctgggctggtctgggctgggctcagctgagctgggctgagctgggctgtgctggtctgggctgggctgaaccaggctgagctgggctgggctttgatgggctgagctgggctgagctgagctgagctgggctgggcagagctgagctgggctgagctaggctgagctaggcagagctgggctggactgagctgagctgggctgggctgagctgggctttgatgggctgagctgagctgtgctgagctgagctgggctgagctgggctgtgctgagctgggctgagctgggcatggctggctggactgagctgagctgggctgggcagagctgagctgagctgggctgagctgtgctgagctgagctgggctgagctgggcatagctgggctgggctgagctgggctgagctgggcttagctgggctggactgagctgagctgggctgagctgggctgggctgagctgagctgggctgagctgggctgggctgagttgggctgagctgggctgagctgggctgaaccaggctgacctgggctgagctgaccttggctttgatgggctgagctgacctgggctgggctgacctgggctgagctgaccttggctttgatgggctgagctgggctgagctaggctgagctgacctgtgctgaggtgagctgggctgagctgagctgggctgagctgggctgggctcagctgggcagagctgagctgggttgagctggctgagctcggctgggcagagctgggtcaattgggctggactgggctgggcttggctgggctgagctgggctgagctgggctgaaccaggctgagctgggctgggctgagctaggctgagctcagctgaactgagctgggatgagcagagctggactgggctatcctgggctgagctgaccttggctttgatgggctgagctgggctgaaaggagctgtgctttgcagggctgagctgagcttggctgagctgggctgggctgacctgagctgagctgggctgggttgagctgggctgagctgggctaggctgggctcagctgggcagagctgggctgggctgacctgtgctgagctgggctgggctgagctgagctgagctgggctgagctgaccttggcttgatgggttgagctgcgctgagctgggctatgctgggctcagctgggcagagctgggctgggctgacctgtgctgagctggcctgggctgagctgggctgagctgggcagagctgggctgggttgagctgggctgagctgggctgggctgggctgagctgggctgggctgacctgagctgagttgtgctgggctgggctgggctgggctgagctgggctgggctgggttgggcttggctgggtttggcttggctgagctgtgctaggcagggcagggctgggctgacctgagctgagctgggctgggttgagctgggctgggctgggctgggctgggctgggctgggctgggctcagctgggatgggttgagctgggctgggctgggttaggctgggctgagctggtctgaaccggtctgaccagggctgagctgagctgggctttgatgggctgagctgagctgagctcggctgggctgggcagagctgggctgagcagggctgagctgggctgggctaggctgggctgacttgggctgacctgagctgagctgggaagggctgggctgggctgagttgggctgagctgagctgggctgagctgaacttagctggcctgagctgggctgggctgggctgaacttagccggctgggctgagctgggctgatctgagctgggctgagcagagctgagctgggctgggctgagctgggctgggctgagctgagctgaactgggctgggctgggttaagctgagctgggctgggctgtgctgggcttggctgggctgagctgagctggactggactgagttgtcctgggctgacctggtctgacctgagctgagttatgctgggctgagctgggctgagctgagcaagctaagcaagcctgcactgagctgggctggaatgggctgggtggatctgaggttgactttgatgggctgagctgagctgagctgacttaggctggactgggcgggactgggctgtgctgtggtgggctggactgggctgagcagagccgacctgggctaggctgaagtgacctgggctacacggggctgagcttgtatagaccaagcttagctgggctggactgggctgagcagagctgaccttgccttgtatggactaagctgggccaaacttagcttgctgagctgtgctaaggcgacgtgacttgggctaggctgacccgggctgagctgagctgggctgagctgggctgtgctggactaagctggactaagctggacttgagctgggccggactggttgatgtgaacagtgtcttctggactctctgggaactgccaagtatgtatctgaggctgagctacttgctgaggttcaaggtttctggagtgacagtggtcaagcccagagcacacagtgcagccaaagaaggcctatgttcctagggcggagcctgtgcctctgggcgctgtcggtcacctctgtcctgcaggactcagagatgtcctgggcaggaggcggcagtgtggtcagagctccaggaacaagcgctccttggcattgggagccctggtggccaggagggctggcgactgctgctcatgggggaggggtgtgagtgtgggaactgtggggccaggacgagggtctgggaccctgacaaagaaagtgcaaggtgggcacagagctgggtggaccccctggctccccaaagccctcaccaagcccatgctcctccggcctggccaggcccttcctctacacccacccttcagcaccccaacctgtgtacactgcccaaagaagcctaaggccctgagagcctggggcctgcgatggctcagtgccagccaagcacagtctagaggagcctgggagacacagggcagcaggagtcagctggacacttctggccctggtcctggcccagccgctgtttgaccctgggctggtctcctcccctctctggaccagcttctggcgagatgaggcaggtggggccctgtgctcccagggcactctggggtagcagtctcgtggctgcaaaagtctcacagtgtgtcctgtattgcagt

SEQ ID NO: 80 - DNA, 131 bp, Oryctolagus cuniculus
gtcagaggcggctggggggccctgaggctgcagagtgggctgcggggctggaccactgagctggaacagaggacagcctacacagggatgaaggaagggcactgacactccatcttctctgtttcatcaga

SEQ ID NO: 81 - DNA, 179 bp, Oryctolagus cuniculus
gtgggcctacccccacccccaggcaatgggctactctcctcaccctggcctgactcctccctcccctcctgggctctgaggtacactccccggctcacagagggaaactgaggccggtgtgcaggacagtggggctcagtcctctcctgtggccctgaccccactttgcccctttcagg

SEQ ID NO: 82 - DNA, 2046 bp, Oryctolagus cuniculus
gccccatggccctgccctgaataaactccgtgctcgcccccagcagccctgcgggttcattgtgcctgtctgtctcctcaggggctgcagccacagtgcggagagggggagcacccctggtcctaaagtaggggcctcggatacctggaggggacatcatgcatggtgcccgtgagtgtgcatgtgagtgtgagtgtgagcacaggtgcctgcgggagtgagtgtgtctgggaatgagtgtgcctgggagtgagtgtgtagggagtgagtgtgtctgggagtgagtgtgtctgggagggagcagtgagaggggaggctgagctggggtggattctgaggcagtgcaggcacagctcaggtcgcacccagagccgtggacaccaccaggagttcctgggcggcagggatgcagccattgccctggtgcagaggacgagggagggagggagggggaggaacaggggctgggtgcagggacccctgggaagaggggcaccagtcaggcccccccagaccagcagaggtctgccccaggcggacaccacccagcagtgcaggacagcgctgacacacacagggcacacagcaggccccaccccgcaccacgctctctggggcctgcacacagcacacatgctcacagggcacacacgcttacacatgtccccctcagctgcaggagagctcacagcccagacccagctccaggaaagcaaggggagtccccatccaagccccagatggttttcctaggcccagccctgctgcccaggcccctgcttgcccgctctgggcctccctgaaagtccaggaatacacagctcaaggatcatttgcacagcccaaactaggcaggccctgctcactgctgggccaacagaataaaccctccaatcctctcaaagcccaagtctgagccaaaccacaggcagagagggacaggacagagaccactgacacaggcccctcctcagagcttgggcttctgattcacaccccaggagcccctgaacagttccagaccagtgtaggaaactaggcaccaggactcccagggcacggggcctctgctcctgcctcagacacccttggggcctcccagggactctggctctggcaacctcccttgtcagtgcccaggtgaagaggatcccacacacagccacttctctccccagagggtggcatccaaaagagttacagggagaggaacaggccaggtggggaaatggtactcacacaagtaccccagccaccccatgggaccaggaactgagccaaataggcagcttcctaagaaagagagaaagggggagaatcatcatggagagcagacagattagcccaagacccaaagatgtagtggaacacggacagatggctggatggatgactgatgcacaagtagatggatggatcagtggatggatggatggattatagctatatagaggagtcaagtcatggatggataaataattgatagattatttatagatgagttatagatatgactgctatacaagtagaggacaaacagattcaactccaaattaacacagatccatcagccaggacctaggacgtctggtccactctgctggctgctggctgctggccttcgctggcgatccctcagccacttccctggggaagaacagaggctctgctcacaccatggtccctgctcatgccctgggcacaatgaccccacactcagaccttgaggtgtgcctggtcctctctggacccaggtcccggccaaggccagcccaagagcagggcttaggcaggagccactgagtacgtggctcagatcaggccagcagggctccggccacaccttccctggaccagcaaggacactgccccgcctcctgtcctgcagctgtgctaagacacttgcaggggccaaccccccatggaccctgctctcgccctcagtccccataggagatcccaccactctgcccccagccccctgagaaggcgtgcgagggaaggccttgggcccaggccccatgcacacattcacgtcctggcagg

SEQ ID NO: 83 - DNA, 6896 bp, Oryctolagus cuniculus
gccccatggccctgccctgaataaactccgtgctcgcccccagcagccctgcgggttcattgtgcctgtctgtctcctcaggggctgcagccacagtgcggagagggggagcacccctggtcctaaagtaggggcctcggatacctggaggggacatcatgcatggtgcccgtgagtgtgcatgtgagtgtgagtgtgagcacaggtgcctgcgggagtgagtgtgtctgggaatgagtgtgcctgggagtgagtgtgtagggagtgagtgtgtctgggagtgagtgtgtctgggagggagcagtgagaggggaggctgagctggggtggattctgaggcagtgcaggcacagctcaggtcgcacccagagccgtggacaccaccaggagttcctgggcggcagggatgcagccattgccctggtgcagaggacgagggagggagggagggggaggaacaggggctgggtgcagggacccctgggaagaggggcaccagtcaggcccccccagaccagcagaggtctgccccaggcggacaccacccagcagtgcaggacagcgctgacacacacagggcacacagcaggccccaccccgcaccacgctctctggggcctgcacacagcacacatgctcacagggcacacacgcttacacatgtccccctcagctgcaggagagctcacagcccagacccagctccaggaaagcaaggggagtccccatccaagccccagatggttttcctaggcccagccctgctgcccaggcccctgcttgcccgctctgggcctccctgaaagtccaggaatacacagctcaaggatcatttgcacagcccaaactaggcaggccctgctcactgctgggccaacagaataaaccctccaatcctctcaaagcccaagtctgagccaaaccacaggcagagagggacaggacagagaccactgacacaggcccctcctcagagcttgggcttctgattcacaccccaggagcccctgaacagttccagaccagtgtaggaaactaggcaccaggactcccagggcacggggcctctgctcctgcctcagacacccttggggcctcccagggactctggctctggcaacctcccttgtcagtgcccaggtgaagaggatcccacacacagccacttctctccccagagggtggcatccaaaagagttacagggagaggaacaggccaggtggggaaatggtactcacacaagtaccccagccaccccatgggaccaggaactgagccaaataggcagcttcctaagaaagagagaaagggggagaatcatcatggagagcagacagattagcccaagacccaaagatgtagtggaacacggacagatggctggatggatgactgatgcacaagtagatggatggatcagtggatggatggatggattatagctatatagaggagtcaagtcatggatggataaataattgatagattatttatagatgagttatagatatgactgctatacaagtagaggacaaacagattcaactccaaattaacacagatccatcagccaggacctaggacgtctggtccactctgctggctgctggctgctggccttcgctggcgatccctcagccacttccctggggaagaacagaggctctgctcacaccatggtccctgctcatgccctgggcacaatgaccccacactcagaccttgaggtgtgcctggtcctctctggacccaggtcccggccaaggccagcccaagagcagggcttaggcaggagccactgagtacgtggctcagatcaggccagcagggctccggccacaccttccctggaccagcaaggacactgccccgcctcctgtcctgcagctgtgctaagacacttgcaggggccaaccccccatggaccctgctctcgccctcagtccccataggagatcccaccactctgcccccagccccctgagaaggcgtgcgagggaaggccttgggcccaggccccatgcacacattcacgtcctggcaggccttctgtgtcttgcaggttgtcaggagcccctgccctgtgtggtgctggatctgccacaggacagcctggaggaggaggcccccggcgccaacctgtggcccaccaccgtcaccctcctcactctcttcctgctgagcctgttctacagcacagctctgaccatgacaaacattcggggtccacctggcagcaaagagggaccccagtactgaggcacaggtgtggggatgccctgggcaggggggaaccgggcccaaggacagatgactgctgctgccatagaggggcacacgggtccctgcaggaactgggacatgggtgccctgggtcagggtgggagcgtccctgggtgcaggatctgaggattccaccaaggctcccgggagccaggcccaggctgggacaggggagagggtgaggacaccgcccaccctcagctgcccctgtctctgcaggagggaagcgtgcaggagcccctgggaaagccagctctgcatgccagagcccagccctccatgaagcattgaaacccccatccccctgccaggtgcactcaacccttcccagacgaatgttctcgctctgctggacgatggctcagggaagccacgtgacttcagactgggagacaactgccactccaccacagggacttcagcatggactggacgcggtgacccacacatggcctggccctgcaggaggctcaagtccaagaccagtgcttcccctgggagggctcaggaggatgcctccttggaagtggccttggaactggtcctgcacactgggccctggtccttggcactgagacctggtgcttattactgagccctggtcctgtcatggagctctggacttgagtactggatctgggtctcataactaagccctggtctgtacattgggccctagtcctgatctctgagccctgggcctgtgtactgagccctggtcctggtcattcatctctggttctgctcactgggcccgggttctgctcactcagccctggacctgggccctgctgctggtcctgaccctgtcactggttacagctcccgcccctgactctggatcctgcgtttgcccactgctccctggggctactgctgagccctgcttcaggtcctgagttgggtcctgaacacaggcagtggccctggtcagtaacccaagctccaggtcactgcccctgtaactggtcagcgagctgaggtcagcttattcatcctggtctgagctcggggcaactcctcagcactgattcctggtgccatccctggtccatagccctgagcccaggtcctgggaaccgcaccctgggagtgatcactgatccacactcagatcactcggcactgcctgacccagatgatgacctggctcctgcttgcttaggcccagtcccagccaaggtagctttgggggagtgaatcaatggacgtatgatttttctctgtctctctctcagtctctctctctatctatctctatctcttcaacacacaggggccagcattgcggcacagtgataaacgctgcctgggatgccagcaactcatgtgcgcaccagttcatttcatggtaccagcccagctctctgttatgcagctgggagagcacagaggaggcccaaatgtctgggtccctgccacgcacgggagagacacagatgaagcccctggttcttggcttcagcctgacccatccctggccatcacagccatctgggcagtgaaccaaccacaagctctctggtctccctctctctgtctctgtaactctggctttcaaataaagaaataaatcttttctaaaaataacaactccgcccccatcaggatgaaaccatgggaataattcggtctagaatgaacctagctgagcccagcagcggccactgggacagccacacagccagtgccgccccagctgagggaagcgggtgcaagccctcagatctcaggggcaaaggcgcccactcgtgcaatctcagccacagggcgtgggagcttctgccgagattcagcgagagaaagggcacaggtgcgcacacaggaagggagagttaagtgagccctgcaggagaaggcgctgcctccacacagagggaagctgcaccaccaggcctcagggccacagccaggaggccatcacacgaggtcagcccctgtgtgcaccgctgaccacctggctgaggaaaacacagagagagccaccccattacaacatccgcctagaactggtcccggccccaggtccctgcccggaggaaacgaggtcagaggtcagggagaggcactgtccctgctcttggcagcactgcccccagtagcaaaagccaggactcgacctaggtgtgcacggacagagactgggcaaagaacaagtgcttcctgtgcaccacgaaacaccatcactcacacacacaaaaaatactacacacatacccacaaaaaaagcgttcatggaccacgaaataccatacacacacactgtgaaataccacacacacgtacaccacgaaatatcacacacacacacacacacacaacatgaaatactgctgacatgtaccatgtaataccacacacacatacaccacaaaatatagcacacctacacaccacaaaataccacacatgtactacatgatatacagcctacacatacaccatgaaatccacacacacatatgtacaccaaaaatacagcccacatcaacaggaagaactgtaaacaagtacaccctaaagtaccacccctctacactcagaaatatcatctccacgtacccctgaaaattcaccctaaattgtcatccacgtgtgcaccctgagacacccacgtgtgcaccctgaggcgtcgtggaccccgtgaagagccctcacctttcagagaggaaatttggtcttggccacaggtgcaggagcctggcggccaccgtgccctcaactgcgcctggcccagaggagcacgcgctccatggctctttgtcacatgatatctgagagctcagggcggtatcatgggagcctgttgaggaggggggggacacccagggtgagaacacaatgggacaggatccccgggcgctcaggtgcggctcagggggacagcgcactgcagggcctggagcacaccagcccccgcgtcagcgccagctcagccccggctgctccgcttcctccccagatccctgctctgcgcctgggaagacggtgggtgttggctcagtgctcgggccctgcacccacgcaggagaacagagggagttctgggtggagcctgtgcctctggggttctgtcaatcaccctgtcctgcaggactcagagatgtcctgggcaggaggcggccgtgtggtcagagctccaggaacaagcgctccttggcattggagtcctggtggccaggagggctggcgactgctgctcatgggcggaggggagctgagtgtgggtttcctgggacgggaggagggtctgggtccctgtcggggtactgcaaggtggggacacagctgggtggaccctctgcctccccacggccctcacgaagtccaggctcctctggcctggccagccccgtcctctacaccgacccttcaccacccccaccctgtgcacactgcccaggggacctgaggccggggagcctggggccttcaaaggctccgtaccagccaagcttgagcagctcagccccgaagagcccgggagacacagggcagcagagccagatggacacttccggacccagtcctggcccagctgctgtgtgaccctgggctgctctttccccctctctgggccaggttctgactgtgacgaggcggggggtcctgtgctcctagggcgctctggggttgcagccacgtgcctgcggtggtctcccagcgtgctctgtgttgcggagaacgcagcccctcccagcctcttcccgctgagcctccccatgcttgtgtcaaaagggaattcacagaccgtggtcgtcagctgcttgatccgggactccttccccctgggccctctgagtgtactggaacaactgcggggagaacgtgagcgtctataacttcccgcctgcccagtctggcacttcaggcccatacaccgcatgcagcgagctgatcctaccacctgacaggtgtcctgcagatgacagtgtggcctgccacgtggagcacagtacgatgagggccagctttatagatgtgtgaaatgatagatggatagatacataatctactgatagatacataatctactgatagatacataatcagatagaataatagatacacaatctactgatagataggattcatttgccagtatatgagaaaaggttcaactccaatttaagatgagagatcaatgcttaggacctgaggacatctgctactctgtgctgcgggccttcactggccatccctcagccacattccctggggaagaacagaggatctgcacacaccatggtccctgctcacgccctgcgcacactgaccccacactaagacccttgaggtgtgcctggtcctctctggacccaggtcccggccaaggtcagcccaagagcagggcttaggcaggagccactgacacatggctcagatcaggccagcagggctccggccacaccttccctagaccagcaaggacactgccccgcctcctgtcctgcctgctgggctaagacacttgtaggggccaaccccccatggaccctgctctcgccctcagaccccatagagaccccaccactccacccccagcccctgaggaggtgtgggagggaaggcctggggcccagggcccacccacacgtcaggtcctggcagg

SEQ ID NO: 84 - DNA, 14042 bp, Oryctolagus cuniculus
gccccatggccctgccctgaataaactccgtgctcgcccccagcagccctgcgggttcattgtgcctgtctgtctcctcaggggctgcagccacagtgcggagagggggagcacccctggtcctaaagtaggggcctcggatacctggaggggacatcatgcatggtgcccgtgagtgtgcatgtgagtgtgagtgtgagcacaggtgcctgcgggagtgagtgtgtctgggaatgagtgtgcctgggagtgagtgtgtagggagtgagtgtgtctgggagtgagtgtgtctgggagggagcagtgagaggggaggctgagctggggtggattctgaggcagtgcaggcacagctcaggtcgcacccagagccgtggacaccaccaggagttcctgggcggcagggatgcagccattgccctggtgcagaggacgagggagggagggagggggaggaacaggggctgggtgcagggacccctgggaagaggggcaccagtcaggcccccccagaccagcagaggtctgccccaggcggacaccacccagcagtgcaggacagcgctgacacacacagggcacacagcaggccccaccccgcaccacgctctctggggcctgcacacagcacacatgctcacagggcacacacgcttacacatgtccccctcagctgcaggagagctcacagcccagacccagctccaggaaagcaaggggagtccccatccaagccccagatggttttcctaggcccagccctgctgcccaggcccctgcttgcccgctctgggcctccctgaaagtccaggaatacacagctcaaggatcatttgcacagcccaaactaggcaggccctgctcactgctgggccaacagaataaaccctccaatcctctcaaagcccaagtctgagccaaaccacaggcagagagggacaggacagagaccactgacacaggcccctcctcagagcttgggcttctgattcacaccccaggagcccctgaacagttccagaccagtgtaggaaactaggcaccaggactcccagggcacggggcctctgctcctgcctcagacacccttggggcctcccagggactctggctctggcaacctcccttgtcagtgcccaggtgaagaggatcccacacacagccacttctctccccagagggtggcatccaaaagagttacagggagaggaacaggccaggtggggaaatggtactcacacaagtaccccagccaccccatgggaccaggaactgagccaaataggcagcttcctaagaaagagagaaagggggagaatcatcatggagagcagacagattagcccaagacccaaagatgtagtggaacacggacagatggctggatggatgactgatgcacaagtagatggatggatcagtggatggatggatggattatagctatatagaggagtcaagtcatggatggataaataattgatagattatttatagatgagttatagatatgactgctatacaagtagaggacaaacagattcaactccaaattaacacagatccatcagccaggacctaggacgtctggtccactctgctggctgctggctgctggccttcgctggcgatccctcagccacttccctggggaagaacagaggctctgctcacaccatggtccctgctcatgccctgggcacaatgaccccacactcagaccttgaggtgtgcctggtcctctctggacccaggtcccggccaaggccagcccaagagcagggcttaggcaggagccactgagtacgtggctcagatcaggccagcagggctccggccacaccttccctggaccagcaaggacactgccccgcctcctgtcctgcagctgtgctaagacacttgcaggggccaaccccccatggaccctgctctcgccctcagtccccataggagatcccaccactctgcccccagccccctgagaaggcgtgcgagggaaggccttgggcccaggccccatgcacacattcacgtcctggcaggccttctgtgtcttgcaggttgtcaggagcccctgccctgtgtggtgctggatctgccacaggacagcctggaggaggaggcccccggcgccaacctgtggcccaccaccgtcaccctcctcactctcttcctgctgagcctgttctacagcacagctctgaccatgacaaacattcggggtccacctggcagcaaagagggaccccagtactgaggcacaggtgtggggatgccctgggcaggggggaaccgggcccaaggacagatgactgctgctgccatagaggggcacacgggtccctgcaggaactgggacatgggtgccctgggtcagggtgggagcgtccctgggtgcaggatctgaggattccaccaaggctcccgggagccaggcccaggctgggacaggggagagggtgaggacaccgcccaccctcagctgcccctgtctctgcaggagggaagcgtgcaggagcccctgggaaagccagctctgcatgccagagcccagccctccatgaagcattgaaacccccatccccctgccaggtgcactcaacccttcccagacgaatgttctcgctctgctggacgatggctcagggaagccacgtgacttcagactgggagacaactgccactccaccacagggacttcagcatggactggacgcggtgacccacacatggcctggccctgcaggaggctcaagtccaagaccagtgcttcccctgggagggctcaggaggatgcctccttggaagtggccttggaactggtcctgcacactgggccctggtccttggcactgagacctggtgcttattactgagccctggtcctgtcatggagctctggacttgagtactggatctgggtctcataactaagccctggtctgtacattgggccctagtcctgatctctgagccctgggcctgtgtactgagccctggtcctggtcattcatctctggttctgctcactgggcccgggttctgctcactcagccctggacctgggccctgctgctggtcctgaccctgtcactggttacagctcccgcccctgactctggatcctgcgtttgcccactgctccctggggctactgctgagccctgcttcaggtcctgagttgggtcctgaacacaggcagtggccctggtcagtaacccaagctccaggtcactgcccctgtaactggtcagcgagctgaggtcagcttattcatcctggtctgagctcggggcaactcctcagcactgattcctggtgccatccctggtccatagccctgagcccaggtcctgggaaccgcaccctgggagtgatcactgatccacactcagatcactcggcactgcctgacccagatgatgacctggctcctgcttgcttaggcccagtcccagccaaggtagctttgggggagtgaatcaatggacgtatgatttttctctgtctctctctcagtctctctctctatctatctctatctcttcaacacacaggggccagcattgcggcacagtgataaacgctgcctgggatgccagcaactcatgtgcgcaccagttcatttcatggtaccagcccagctctctgttatgcagctgggagagcacagaggaggcccaaatgtctgggtccctgccacgcacgggagagacacagatgaagcccctggttcttggcttcagcctgacccatccctggccatcacagccatctgggcagtgaaccaaccacaagctctctggtctccctctctctgtctctgtaactctggctttcaaataaagaaataaatcttttctaaaaataacaactccgcccccatcaggatgaaaccatgggaataattcggtctagaatgaacctagctgagcccagcagcggccactgggacagccacacagccagtgccgccccagctgagggaagcgggtgcaagccctcagatctcaggggcaaaggcgcccactcgtgcaatctcagccacagggcgtgggagcttctgccgagattcagcgagagaaagggcacaggtgcgcacacaggaagggagagttaagtgagccctgcaggagaaggcgctgcctccacacagagggaagctgcaccaccaggcctcagggccacagccaggaggccatcacacgaggtcagcccctgtgtgcaccgctgaccacctggctgaggaaaacacagagagagccaccccattacaacatccgcctagaactggtcccggccccaggtccctgcccggaggaaacgaggtcagaggtcagggagaggcactgtccctgctcttggcagcactgcccccagtagcaaaagccaggactcgacctaggtgtgcacggacagagactgggcaaagaacaagtgcttcctgtgcaccacgaaacaccatcactcacacacacaaaaaatactacacacatacccacaaaaaaagcgttcatggaccacgaaataccatacacacacactgtgaaataccacacacacgtacaccacgaaatatcacacacacacacacacacacaacatgaaatactgctgacatgtaccatgtaataccacacacacatacaccacaaaatatagcacacctacacaccacaaaataccacacatgtactacatgatatacagcctacacatacaccatgaaatccacacacacatatgtacaccaaaaatacagcccacatcaacaggaagaactgtaaacaagtacaccctaaagtaccacccctctacactcagaaatatcatctccacgtacccctgaaaattcaccctaaattgtcatccacgtgtgcaccctgagacacccacgtgtgcaccctgaggcgtcgtggaccccgtgaagagccctcacctttcagagaggaaatttggtcttggccacaggtgcaggagcctggcggccaccgtgccctcaactgcgcctggcccagaggagcacgcgctccatggctctttgtcacatgatatctgagagctcagggcggtatcatgggagcctgttgaggaggggggggacacccagggtgagaacacaatgggacaggatccccgggcgctcaggtgcggctcagggggacagcgcactgcagggcctggagcacaccagcccccgcgtcagcgccagctcagccccggctgctccgcttcctccccagatccctgctctgcgcctgggaagacggtgggtgttggctcagtgctcgggccctgcacccacgcaggagaacagagggagttctgggtggagcctgtgcctctggggttctgtcaatcaccctgtcctgcaggactcagagatgtcctgggcaggaggcggccgtgtggtcagagctccaggaacaagcgctccttggcattggagtcctggtggccaggagggctggcgactgctgctcatgggcggaggggagctgagtgtgggtttcctgggacgggaggagggtctgggtccctgtcggggtactgcaaggtggggacacagctgggtggaccctctgcctccccacggccctcacgaagtccaggctcctctggcctggccagccccgtcctctacaccgacccttcaccacccccaccctgtgcacactgcccaggggacctgaggccggggagcctggggccttcaaaggctccgtaccagccaagcttgagcagctcagccccgaagagcccgggagacacagggcagcagagccagatggacacttccggacccagtcctggcccagctgctgtgtgaccctgggctgctctttccccctctctgggccaggttctgactgtgacgaggcggggggtcctgtgctcctagggcgctctggggttgcagccacgtgcctgcggtggtctcccagcgtgctctgtgttgcggagaacgcagcccctcccagcctcttcccgctgagcctccccatgcttgtgtcaaaagggaattcacagaccgtggtcgtcagctgcttgatccgggactccttccccctgggccctctgagtgtactggaacaactgcggggagaacgtgagcgtctataacttcccgcctgcccagtctggcacttcaggcccatacaccgcatgcagcgagctgatcctaccacctgacaggtgtcctgcagatgacagtgtggcctgccacgtggagcacagtacgatgagggccagctttatagatgtgtgaaatgatagatggatagatacataatctactgatagatacataatctactgatagatacataatcagatagaataatagatacacaatctactgatagataggattcatttgccagtatatgagaaaaggttcaactccaatttaagatgagagatcaatgcttaggacctgaggacatctgctactctgtgctgcgggccttcactggccatccctcagccacattccctggggaagaacagaggatctgcacacaccatggtccctgctcacgccctgcgcacactgaccccacactaagacccttgaggtgtgcctggtcctctctggacccaggtcccggccaaggtcagcccaagagcagggcttaggcaggagccactgacacatggctcagatcaggccagcagggctccggccacaccttccctagaccagcaaggacactgccccgcctcctgtcctgcctgctgggctaagacacttgtaggggccaaccccccatggaccctgctctcgccctcagaccccatagagaccccaccactccacccccagcccctgaggaggtgtgggagggaaggcctggggcccagggcccacccacacgtcaggtcctggcaggccttctgtgtcttgcaggttgtcaggagcccctgccctgtgtggtgctggatctgccacaggacagcctggaggaggaggcccccggcgccaacctgtggcccaccaccgtcaccctcctcactctcttcctgctgagcctgttctacagcacagctctgaccgtgaccagcatccggggcccacctggcagcaaagagggaccccagtactgaggcacaggtgtggggatgccctggggaggggggaactgggcccaaggacaggtgactgctgctgccatagaggggcacaagggtccctgcaggaactgggacatgggtgccctgggtcagggtgggagcatccccaggtgcaggagctgaggattccaccaaggctcccgggagccaggcccaggctgggacaggggaaagggtgaggacaccgcccaccctcagctgcccctgtctctgcaggagggaagcgtgcaagagcccctgggaaagccagctctgcatgccagagcccagccctccatgaagcattgaaacccccatccccctgccaggtgcactcaacccttcccagatgaatgttctcgctctgctggacgatggctcagggaagccacggtggctgcagcctgggagacgcctgccactccaacacagggacttcagcatggactggacgtggtgccccagacacggcctggccctcaggagtctcaagtccaagaccagtgcttcacctgggctcaggaggacgcctccctggagtggccatggacctggtcctgagcactgagccctggtcctgctcactgagccctggtcctcgtcactgagccctggtcctgagcctgggcctggtcccatttcacacaccaggactcctctggagctgcatcctctaaggctctgactttgaacatatgctgagccctgagtgctgaccgctctaggacgtgacctgcaggaaggccacagccctcagggaggccccggcgggcaccgcttgcagatgcagtcacggccgcactcctcatcctcactccgtcctctcaggccctgaggggttgcaggggtggagaggggacaagcccaggccccgggctgcctgaggtggactcagtgcctgcggtccccgggtcaggggtgcagcgcaggtgggaccgaggaggacgggcggtcgtgttgttttcccctgtgttgctccttcttcagaagcttcctgtgcccgtgcacctgctgaaacccctgaaatagccctgggccggctgagtcatcccaggcacagcccaggtgtccccgctgagaatcctgttctcaggccctccacggaggcctggccagattgccccgaggcctgggcaaggacggacagccccgtggggaccatggggccctcgcacccctcaggacagggtctcacggatggcacccaccagccccagccaggcttcaggaaggccaagagctcaggttagccgggaccagcctgccttccgccagggtcagcccaggccccgctggcttccaccaggtcaggccgtctcagccaggccatctcccaggggcactgacccacagcacagcagacccacggggacccgggctagcacttgccaccgcacctcagcgtccccctgcctgtgtcagggctgatgaagggcacagcctggcccagccccagcctttgcagccctctgggagggaaccagcacacacaggatctctctccttctctgtaattctgccttcaaataaataaatctttaacgagaaaaaaaagctgtgctggagcaagggcgccacacccctgctgagcgagcacagccccccccccccaccagggcccgcagccaaagccccgctctgctcagagcaccagctccaggctcggggaaggatgtcacggggacgccgctgtgggctgcgggtcaggggtcccggcaccccgtgggcccagagctgcaaccagcaggggaagggcagcagcacagacaccctcaaactacaccaccctgatggaagtgtgaccttgagcgaggccaccaatcaaagccgatgtagaaaaatctctctgtcccccccaacagactctctccctactcccacccacctccacgcacaggcagtgctgagaccacaggacaggggcccagtgacagcaatggccccaaggagacaacaaaggacatccctgcctcagggtcccacctggcagccagggactgaggcctgcccgggtccaccccgaggacatgggccgagccaggacagcaggacccgcctccagccctaccttctgccccgggccctgcccccaccacagctgcaggaggccggcccactgcttcccagggaggttgcttcctgagggctcctcccgcccatggaccccgtcctccacacacagggatgagctcaggacgcccactgcggctgacgactcggcgacaccctcacagcacgacccctgtggacgcctacggaagcgtcgggctgagtgctcgccccaccccagcccctctctggggctctgggacctggaagagggtctcgggcacaggtgtccaggaagtgcagcctctgcagctgagaccccgcctgcgaggagctggcacggagcctccccacaggacggacaaaggctccatgggacctcaaatgctgctgccagagcccaagagctgcgatttcaaactcgggggaaacggaaggaaggaggcagtgcggagaaagagagaaatgtgcaaggggcagggagtccggcctggctggagcagctccaaggtctgcccacctgggctcctgctgggccaccgacccgccatggaaaccacggggctgcaatggctcccgggtctccctcgcttcctgaggctgcccagtccctctcctgccacaccagcaccagtcctgagggctcaggggagctgtcccggccagcgagccagggacacagccaccacggtgtgagttctccgagtgtggagtccacgtctctggggtcacggcccagacaaaccccgagcagatgagactgtctttgttctacactggcctgctttggtcccagacacaaggccaccagaccagccccgggaccagtgtccagcctcggctgcagctgccccagaccactccccgccctgtgtcctgggtcatggcaaagcccaggcagggacaggtgtgtggcacagcaggtgaagctgcctcgggacacccgcagcccacatgggagcacctggggtcacggcctggctccgcctccgattccagcttcctgctgacctgcacctgggaggcagcagtgaccactccactcctgggccctgccacccacaagccagacccaggctcctggcttccgcctgcccagtcccggctcttgtgggcctcggggagccaaccagcaggtggaagatcttcctctctctgttcctccctctctgccgccctcccgtgaggacagacgaaaacaaacgaggccagcagttgtgggagagcccctgtcccccccagggccggcgcctgtgctcccgtggcagagctggccgtggaggggctgttccctgtggaggacggcccaactgtgtcactcggcaaaccctgatcccaccgggcggtgtcggggtcaccagggtgcagcccacagtgggatccctgccttaggaaaagcacccagcgtgacctggctcctctccctgccaggggacggcacctgcagtgatcgccctctgtgcagatgagggcacccaggtgagctcgctctccctctctccctctctctctccctctctccctctctccctctctccctctctctccctctctctctccctccatctctctctctccctcccctccacccgaggtgtggacactgggagaagaccccgccctgactctggctccagcctgcagaacggggagaaatcagtgccttctctgaagcctgcccgtctgcgctgtgtttgctgcagccgtcagcaatgcctaagacgcacggccacgaggtccccacactgagagtgcggccgtcacaacacctgccgagctccctgtggccaggccagggcacatctgccgggaccaggggccacgccacaacctagcctgctgacctggcccctgcacctcccaggctcgccgtgctgcctctgtggccagggggcttcaggtcacccacacttgacaagaaactgccgggcccacctctgggaagcccccaggccccagcccagccaacccaggccctgtggagctgggcaggtgtgtgcagcccctaccagctcacctgccactccccgctccccgacaaacccagacctccctgggtgaggacacgcgggtacctgagtgtggctacggaaccctaaggagagaagacatgggccagcaacactgacgggacagcaactaagacagggcagcctggagagagatggggtgggggactggggtggatgcagggagccagggccaggaagagcctcaccctctgccagtcacaggccagagaccccgagtgggagaaggcagagctggaactgcagggggcttcagtcaggacccccgctgtcgttggggctgacaggacagtagctatccccaccctataccaaccctgagacccaaaggcagccctgtcccctgaccctggccctcccatgaatggggccttctctcggcctgggctagcactcccagctctccgtccccatccctgtcccagtgtctctgagactctgtgtccatttgtgcctctccttcccgaatcagcccccagccctgtcctgtggccggccacgtggagccgtcatctctcacggcccctggtgtcaagggcacagatcacacacacctgtccccaccacagacaaaccacagacaaacatgacaagggggcaagctgcactgtctgctgggacaggaagtggtgagtgaccccaacgtggggccagacccacagccacgcagcctccccagcctgcactcagcagccagccccagcccagccatgggcaaagagccagagcaggtgcacagcgctccaggagggcccggaccaggcctggctcccactccactcggcccctctgggccagcagcagagggagttgatggggagctctggcccagagtgtggacccgcagtgcagggcagcctggccagggagacctgaccctccacggtgctcctccagcagcccagacaggtgggtccacgggatgctgcccctctgcacaggggcagtcgcagccaggctggtcctgaggctcctgggggcagagggagaacaggcatcagccaaagaagggagggagagggggaccacggccaggagcccagcgaccacaggcaggacacagccactggccgggagaggctgggacagggggctgagcccggcagagcccagctcagtcaggatgagccgagtccctggatgcagtgccaagagccctgcaggctgatctggacatgggctgggctgggacagagacgagcagaggaggacgtagggaacctggtggacgcccaccccctactgaactgggctgggctgggctgatctgggctgagctggtcttcgttcagctgagccctgcaggctggcctgaaaggcctggctgggctgcccaggactaatctgatcttagctgggctgtgaagagctgagctggagtaagttgtgctgatctgagtggaattgagctcagctgacctggttagggctgagagctgacctgggctgggtgggctgagcagggctgagctgagctgtgctgggtgggctgagcagggctgagctgagctgtgctgggtgggctgagctgggcagagcagggctgggctgaggtgacctgactgggctcagctgtgctgggtgggctgagctgggcagagcagggctgggctgaactgggctgggctgggctgatctgagctgtgctgggtgggctgagctgggcagagcagggctgggatgaaatgggctaggctgggctgggctgagctgtgctgggtgggctgagctgggctgaggtgacctgactgggctgagctgggctgggctggtgagctggctgaggtgacctgtgctggatagaacttggatagactgagtaggtggagctaggctaagctgggctgagttgaactgagcaggactgaactgggctgggctgatcacacctgcgcttggctgggctgggcagggcggaatgagcctggcagggctgagctgggcagagctgggctgagctgggcagtgttgaacggatccggtccgctgagcatagcgtgtgtggacgaagctgggctaagttgagctgagctgggctgaggagggctgagcaggacagcgagggctgagtgggctgagcttgcaatctctgaggcctctgggggaagtgcaaagtctgtgtctggggctaagctggttcccaggtgtggggttccaggcatgaaaaccattgaagacctgagccctagtgcagtagggggcgcctgtgctcctagggcggagcctgtgcctctgggcgctgtcggtcacccctgtcctgcaggactcagagacgtcctgggcaggaggcggccatgtggtcagagctccaggaacaagcgctccttggcattggagccctggtggccaggagggctggcgactgctgctcatgggggaggggtgtgagtgtgagacgtggggctggggcgagggtctgggaccctggcaagggcagtgcaagctgggcacagagctggaccccacccctgcctcccctcggccttcaccaggcccagcctgcttcactgctccacccagcctgtcccctcctcccttcagcaccccaccctgtgcacactgcccaggggacctgaggccggggagcctggggccctcgacggctccgtgccagccaggcttgagcagctcagccccgaggagcctggagacacagggcagcagagccagctggacacttccggccccagtcctggcccagcagctgtgtgaccctgggctggtctcttcccctctctgggccaggttccggctgggatgaggcaggcagggtcccgtgctcccagggctctctggggttgcagccatgtgacttcgacggtctcacagcgtgtcctgtattgcaga

SEQ ID NO: 85 - DNA, 134 bp, Oryctolagus cuniculus
gtaggagggcggctgggggccctgaggctgcatgtgggctgctgggctggacaatacttgggggatggcagcctggccaggatgtgtgagctgcacactgacagatgtggctctctctgtttccacatgtccag

SEQ ID NO: 86 - DNA, 179 bp, Oryctolagus cuniculus
gtgggcctgcccccacccccaggcaatgggatgctctcctcaccctggcctgactcctccctcccctcctgggctccgaggctccctccccgtaaaacagagggaaactgaggccggcgtgcaggacagtggggctcagtcctcccccgccaccttgaccccactctcccccttccagg

SEQ ID NO: 87 - DNA, 2267 bp, Oryctolagus cuniculus
gcccctggcctgccctgaataaactctgtgctcgcccacagcagccctgcgggtttattgtgcctgtctgtctcctcgggggctgcagccacagggcagggagggggagcacccctgatcctaggagctggggtctcgggcacctggaggggacatcatgcatggtgcccgtgagtgtgcatgtgagcgtgagtgtgaacacaggtgcctgagagtgagcatgtctgggaatgagtgtgcctgggagttggcttgtctaggagtatctctgagagtgagtgtgtctgggaatgagtgtgtagggagtgagtgtgtctgggagggagcagtgagaggggaggctgagctggggtggattctgaggcagtgcaggcacagctcaggtcagggcccagagccgtggacaccaccaggagttcctggcagcagggatgcagccattgccctggtgcagaggacaagggagggaggggggaggaacaggggctgagtgcagggacccctgggaagagggccaccaggcaggactcccagcctaagagatgtccgcccaaggcagacactgcccagcagtgcaggacagcgctcacacacacagggcacacagcaggccccaccccgcaccacgctctctggggcctgcacacggcacacgtgctcacagggcacacacgctcacacacgtccccctcagctaaaggggagctcacagtccagacccagctccaggaaggcaaggggagtcctcgcccaagccaaagacagtttccccaggcccagccctgctgcccagacttctgctggccctctctcggcctcactgaatgtccagccatgcacagctcagagcccagttccacagcccaccctaggcaggccctgcttcctgctgggcaccagactcaaccctccaatcccccctgagcccgagtctgagccaaaccacactcagagaggggcaggacagagaccacccacacaggcccctcctcaggcctcaggcttcttattcgcaccccaggatctcccagaccaatgtaggaacctcgggcaccaggactctgataggcacagggccccagctcttgtctcagatgaccttggggcctcccaagtgctctggctctggccacctcccctgtcagggcccaggtgaagaggagccccacacacagccacttctctccccagagggtcccggcccaaacaactcaggagaaggaagaggccaggcagggaaacggtacccacacaagtactccagccaccccaagggcccaggaactgagccaaaggagcagcttcctaagaaagagggaaagggggagaattaacatggagagcagacagataagccagtgaccacatgacacagtggaacgtgatggacggacagacagatgggtggatggattggtggatacatagatcagtggatggatggacaggtagatggatggttgaaaggatggatggtggctggttacagattgatggatggataggtagatgaatagattcatggatacttaattggttgcataggtaggattgtgggtgggtggatggatggatggatggttttaagttggagagtagatagatgtatgggtggatcaaaaactggataggataactgagggaggggtgagtacatggatggatggaaggatgacactgttagatgtgcgaaatgataaatggatagaaatgtaatattgatagacagataattgatgtaccaaaataggacaaactggtcaactccaatttaacacagagatccgtgacccaggacccaggacgtctggtccactctgctggctgctggctgctggccttcgctggccgtgcctcagccacttccctggggaagaacagaggctctgctcacaccatggtccctgctcacgccctgggcacactgacccccacactcagatcttgaggtgtgcctggtcctctctggacccaggtcctggccaaggccagcccaagagcagggcttaggcaggagccactgacacatggctcagctcaggccagcagggctccggccacaccttccctggaccagcaaggacactgccccgcctcctgtcctacctgctgggctaagacacttgcaaggggccaaccccctatgggccctgctctcgccctcagtccccataggagaccccaccactctgcccccagcccctgaggaggtgtgggagggaaggcctggggcccagggcccacccacacgttcacgtcctggcagc

SEQ ID NO: 88 - DNA, 7194 bp, Oryctolagus cuniculus
gcccctggcctgccctgaataaactctgtgctcgcccacagcagccctgcgggtttattgtgcctgtctgtctcctcgggggctgcagccacagggcagggagggggagcacccctgatcctaggagctggggtctcgggcacctggaggggacatcatgcatggtgcccgtgagtgtgcatgtgagcgtgagtgtgaacacaggtgcctgagagtgagcatgtctgggaatgagtgtgcctgggagttggcttgtctaggagtatctctgagagtgagtgtgtctgggaatgagtgtgtagggagtgagtgtgtctgggagggagcagtgagaggggaggctgagctggggtggattctgaggcagtgcaggcacagctcaggtcagggcccagagccgtggacaccaccaggagttcctggcagcagggatgcagccattgccctggtgcagaggacaagggagggaggggggaggaacaggggctgagtgcagggacccctgggaagagggccaccaggcaggactcccagcctaagagatgtccgcccaaggcagacactgcccagcagtgcaggacagcgctcacacacacagggcacacagcaggccccaccccgcaccacgctctctggggcctgcacacggcacacgtgctcacagggcacacacgctcacacacgtccccctcagctaaaggggagctcacagtccagacccagctccaggaaggcaaggggagtcctcgcccaagccaaagacagtttccccaggcccagccctgctgcccagacttctgctggccctctctcggcctcactgaatgtccagccatgcacagctcagagcccagttccacagcccaccctaggcaggccctgcttcctgctgggcaccagactcaaccctccaatcccccctgagcccgagtctgagccaaaccacactcagagaggggcaggacagagaccacccacacaggcccctcctcaggcctcaggcttcttattcgcaccccaggatctcccagaccaatgtaggaacctcgggcaccaggactctgataggcacagggccccagctcttgtctcagatgaccttggggcctcccaagtgctctggctctggccacctcccctgtcagggcccaggtgaagaggagccccacacacagccacttctctccccagagggtcccggcccaaacaactcaggagaaggaagaggccaggcagggaaacggtacccacacaagtactccagccaccccaagggcccaggaactgagccaaaggagcagcttcctaagaaagagggaaagggggagaattaacatggagagcagacagataagccagtgaccacatgacacagtggaacgtgatggacggacagacagatgggtggatggattggtggatacatagatcagtggatggatggacaggtagatggatggttgaaaggatggatggtggctggttacagattgatggatggataggtagatgaatagattcatggatacttaattggttgcataggtaggattgtgggtgggtggatggatggatggatggttttaagttggagagtagatagatgtatgggtggatcaaaaactggataggataactgagggaggggtgagtacatggatggatggaaggatgacactgttagatgtgcgaaatgataaatggatagaaatgtaatattgatagacagataattgatgtaccaaaataggacaaactggtcaactccaatttaacacagagatccgtgacccaggacccaggacgtctggtccactctgctggctgctggctgctggccttcgctggccgtgcctcagccacttccctggggaagaacagaggctctgctcacaccatggtccctgctcacgccctgggcacactgacccccacactcagatcttgaggtgtgcctggtcctctctggacccaggtcctggccaaggccagcccaagagcagggcttaggcaggagccactgacacatggctcagctcaggccagcagggctccggccacaccttccctggaccagcaaggacactgccccgcctcctgtcctacctgctgggctaagacacttgcaaggggccaaccccctatgggccctgctctcgccctcagtccccataggagaccccaccactctgcccccagcccctgaggaggtgtgggagggaaggcctggggcccagggcccacccacacgttcacgtcctggcagcccttctgtgtcttgcaggttgtcaggagcccctgccctgtgtggtgctggatctgccacaggacagcctggaggaggaggcccctagcgacagcctgtggcccaccaccgtcaccctcctcactctcttcctgctgagcctgttctacagcacagctctgaccatgaccagcatccggggcccacctggcagcaaagagggaccccagtactgaggcacaggtgtggggatgccctgggcaggggggaaccgggcccaaggacaggtgactgctgctgccatagaggggcacacgggtccctgcaggactgggacatgggtgccctgggtcagggtgggagcgtccccgggtgcaggagctgaggattccaccaaggctcccgggagccaggcccaggctgggacaggggagagggtgaggacaccgcccaccctcagctgcccctgtctctgcaggagggaagcatgcaggagcccctgggaaagccagctctgcatgccagagcccagccctccatgaagcattgaaacccccatccccctgccaggtgcactcaacccttcccagacgaatgttctcgctctgctggacgatggctcagggaagccacggtggctgcagcctgggagacgcctgccactccaacacagggacttcagcatggactggacgcggtgccccagacatggcctggccctgcaggaagctcaagtccaagaccagtgcctcccctgggaggactcaggaggacggttccctggagtggccacagccctggttctgagcactgggcccttgttctggtcagtgatccctggtcgtaatatttttgacctggtccttatctctgagcactggtcgtattatctaatctctggtcttgatgactgaatgtggtccggatactggccctggtcatgacgactgagccctggtcctgatgactgagaactggtcataagcactgagcctctatcctgctcactgagccctagtcctaatctctgaatcctgcttctgctcattgggtccttgttatcatcactcagccctggccctgggccctgttcctggtcctgaacctgtcactgactctggaccctgcgtttgcccactgctccctggggctactgctgagccctgcttcaggtcctgagttgggtcctgaacacaggcagtggccctggtcagtaacccaagctccaggtcactgcccctgtaactggtcagcgagctgaggtcagcttattcagtcctggtcccaagctcggggccactcctcagcactgattcctggtgccatccctggtccatagccctgagcccagatcctgggaaccgcaccctgggagtgatcactgatccacactcagatcactcggcactgccgggcccagttgatgacctggctcctgcttgcttaggcccagtcccagccaaggtagctttgggggagtgaatcaatggacgtatgatctttctctctctctctctctctctttctctctctctctctctcattggctcattcactgcaactgccttaaaataaatatatcattaaaagtcagcacccaagggccagcatcatggcattgagtttaactccgttgcctgggatgccagcatcccgtaggggcaccagtttctgttgtggttccaaaccagctctctgctgtgctgctgggagagcacagaagaggcccaaatgtctgggtccctgccacacatgtggagaatcagatgaaactcctggttcttggcttcagcctgacccagccccggccattgtgcccatctggggagtgaaccaaccatagtctctctggtctccctctctctgtctcggtaactctggctttcaaataaagaaacaaatcttttttaaaaataacaactccgccccatcaggatggaccttgggaataattgggtctagaatgaacctagctgagcccagcagcggccactgggacagccacacagccagcgccgccccagctgagggaagcgggagcgagccctcagatctcaggggcaaaggcgtccactcgcgcaatctcagccacagggcgtgggagcttctgccgagattcagcgagagaaagggcacaggtgcgcacacaggaagggagagttaagtgagccctgcaggagaaggcgctgcctccacacggagcgaagctgcaccaccaggcctcagggccacagccaggaggccgtcacacgaggtcagcccctgtgtgcaccgctgaccacctggctgaggaaaacacagagagagccaccccatcacaacatccgcctagaactggtcccggccccaggtccctgcccggaggaaacgaggtcagaggtcagggagaggcactgtccctgctcatggcagcactgccccagtatcaaaagccaggactcgacctaggtgtgcccggacagagactgggcaaagaacaagtgcttcctgtgcaccacgaaacaccacacaaacacatcacaaataccacacacacacacaccacgaaatacagccttcatgtaccacaaaataccacacacaaacagcatgaaataccacacatgtacaccacgaaataccacacacacatacaacatgaaatactgctgacatgtaccatgtaataccacacacacatacaccacaaaatatagcccacctatacaccacgtaataccacacacacgtacaacacgatgtacagcccacacatacaccatgaaatccacacacacagatgttcaccataaatacagcccacatcaacaggaagaactgtaaacaagtacaccctaaagtaccacccctctacactcagaaatatcatctccacgtacccctgaaaattcaccctaaattgtcatccatgtgtgcaccctgagacacccacgtgtgctccctgaggcacccacatgtgctcgctgaggcgtcgtggaccccgtgaagagccctcacctttcagagaggaaatttggtcttggccacaggtgcaggagcctggcggccaccgtgccctcaactgcgcctggcccagaggagcacgcgctccatggctctttctcacatgcaatctagagctcagggcggtatcatgggagcctgttgaggaggggaggggaacacccagggtgagaacacagtgggacaggagccccgggcgctcaggtgcggctcagggggacagcgcactgcagggcctggagtacaccagcccccgcgtcagcgccagctcagccccggctgctccgcttcctccccagatccctgctctgcgcctgggaagacggtgggtgttggctcagtgctcgggccctgcacccacgcaggagaacagagggagttctgggtggagcctgtgcctctggggttctgtcaatcaccctgtcctgcaggactcagagatgtcctgggcaggaggcggccgtgtggtcagagctccaggaacaagcgctccttggcattggagtcctggtggccaggagggctggcgactgctgctcatgggcggaggggagctgagtgtgggtttcctgggacgggaggagggtctgggtccctgtcggggtactgcaaggtggggacacagctgggtggaccctctgcctccccacggccctcacgaagtccaggctcctctggcctggccagccccgtcctctacaccgacccttcaccacccccaccctgtgcacactgcccaggggacctgaggccggggagcctggggccttcaaaggctccgtaccagccaagcttgagcagctcagccccgaagagcccgggagacacagggcagcagagccagatggacacttccggacccagtcctggcccagctgctgtgtgaccctgggctgctctttccccctctctgggccaggttctgactgtgacgaggcggggggtcctgtgctcctagggcgctctggggttgcagccacgtgcctgcggtggtctcccagcgtgctctgtgttgcggagaacgcagcccctcccagcctcttcccgctgagcctccccatgcttgtgtcaaaagggaattcacagaccgtggtcgtcagctgcttgatccgggactccttccccctgggccctctgagtgtactggaacaactgcggggagaacgtgagcgtctataacttcccgcctgcccagtctggcacttcaggcccatacaccgcatgcagcgagctgatcctaccacctgacaggtgtcctgcagatgacagtgtggcctgccacgtggagcacagtacgatgagggccagctttatagatgtgtgaaatgatagatggatagatacataatctactgatagatacataatctactgatagatacataatcagatagaataatagatacacaatctactgatagataggattcattagcagtatatgaaaaaaggttcaattccaatttaagatgagagatcaatgcctaggacctgaggacgtctggtcctctgtgctgcgggccttccgctggccatcccttagccacatttctggggcagaacagaggttctattcacaccatgatccctgctcacgccctgggcacactgaccccacactcagaccttgaggtgtgcctggtcctctctggacccaagtcacggccaaggccagcccaagagcagggcttaggcaggagccactgagtacatgactcagctcagggcagcagggccccagccacaccttccctggaccagcaaggacactgccccgcctcctgtcctgcagctgcgctaagacacttgcaggggccaaccccctatgggccctgctctcaccctcagaccccatagagaccccaccactccacccccaacccctgaggaggtatgggagggaaggccttgggccaggccccacccacacgtcaggtcctggcagg

SEQ ID NO: 89 - DNA, 15282 bp, Oryctolagus cuniculus
gcccctggcctgccctgaataaactctgtgctcgcccacagcagccctgcgggtttattgtgcctgtctgtctcctcgggggctgcagccacagggcagggagggggagcacccctgatcctaggagctggggtctcgggcacctggaggggacatcatgcatggtgcccgtgagtgtgcatgtgagcgtgagtgtgaacacaggtgcctgagagtgagcatgtctgggaatgagtgtgcctgggagttggcttgtctaggagtatctctgagagtgagtgtgtctgggaatgagtgtgtagggagtgagtgtgtctgggagggagcagtgagaggggaggctgagctggggtggattctgaggcagtgcaggcacagctcaggtcagggcccagagccgtggacaccaccaggagttcctggcagcagggatgcagccattgccctggtgcagaggacaagggagggaggggggaggaacaggggctgagtgcagggacccctgggaagagggccaccaggcaggactcccagcctaagagatgtccgcccaaggcagacactgcccagcagtgcaggacagcgctcacacacacagggcacacagcaggccccaccccgcaccacgctctctggggcctgcacacggcacacgtgctcacagggcacacacgctcacacacgtccccctcagctaaaggggagctcacagtccagacccagctccaggaaggcaaggggagtcctcgcccaagccaaagacagtttccccaggcccagccctgctgcccagacttctgctggccctctctcggcctcactgaatgtccagccatgcacagctcagagcccagttccacagcccaccctaggcaggccctgcttcctgctgggcaccagactcaaccctccaatcccccctgagcccgagtctgagccaaaccacactcagagaggggcaggacagagaccacccacacaggcccctcctcaggcctcaggcttcttattcgcaccccaggatctcccagaccaatgtaggaacctcgggcaccaggactctgataggcacagggccccagctcttgtctcagatgaccttggggcctcccaagtgctctggctctggccacctcccctgtcagggcccaggtgaagaggagccccacacacagccacttctctccccagagggtcccggcccaaacaactcaggagaaggaagaggccaggcagggaaacggtacccacacaagtactccagccaccccaagggcccaggaactgagccaaaggagcagcttcctaagaaagagggaaagggggagaattaacatggagagcagacagataagccagtgaccacatgacacagtggaacgtgatggacggacagacagatgggtggatggattggtggatacatagatcagtggatggatggacaggtagatggatggttgaaaggatggatggtggctggttacagattgatggatggataggtagatgaatagattcatggatacttaattggttgcataggtaggattgtgggtgggtggatggatggatggatggttttaagttggagagtagatagatgtatgggtggatcaaaaactggataggataactgagggaggggtgagtacatggatggatggaaggatgacactgttagatgtgcgaaatgataaatggatagaaatgtaatattgatagacagataattgatgtaccaaaataggacaaactggtcaactccaatttaacacagagatccgtgacccaggacccaggacgtctggtccactctgctggctgctggctgctggccttcgctggccgtgcctcagccacttccctggggaagaacagaggctctgctcacaccatggtccctgctcacgccctgggcacactgacccccacactcagatcttgaggtgtgcctggtcctctctggacccaggtcctggccaaggccagcccaagagcagggcttaggcaggagccactgacacatggctcagctcaggccagcagggctccggccacaccttccctggaccagcaaggacactgccccgcctcctgtcctacctgctgggctaagacacttgcaaggggccaaccccctatgggccctgctctcgccctcagtccccataggagaccccaccactctgcccccagcccctgaggaggtgtgggagggaaggcctggggcccagggcccacccacacgttcacgtcctggcagcccttctgtgtcttgcaggttgtcaggagcccctgccctgtgtggtgctggatctgccacaggacagcctggaggaggaggcccctagcgacagcctgtggcccaccaccgtcaccctcctcactctcttcctgctgagcctgttctacagcacagctctgaccatgaccagcatccggggcccacctggcagcaaagagggaccccagtactgaggcacaggtgtggggatgccctgggcaggggggaaccgggcccaaggacaggtgactgctgctgccatagaggggcacacgggtccctgcaggactgggacatgggtgccctgggtcagggtgggagcgtccccgggtgcaggagctgaggattccaccaaggctcccgggagccaggcccaggctgggacaggggagagggtgaggacaccgcccaccctcagctgcccctgtctctgcaggagggaagcatgcaggagcccctgggaaagccagctctgcatgccagagcccagccctccatgaagcattgaaacccccatccccctgccaggtgcactcaacccttcccagacgaatgttctcgctctgctggacgatggctcagggaagccacggtggctgcagcctgggagacgcctgccactccaacacagggacttcagcatggactggacgcggtgccccagacatggcctggccctgcaggaagctcaagtccaagaccagtgcctcccctgggaggactcaggaggacggttccctggagtggccacagccctggttctgagcactgggcccttgttctggtcagtgatccctggtcgtaatatttttgacctggtccttatctctgagcactggtcgtattatctaatctctggtcttgatgactgaatgtggtccggatactggccctggtcatgacgactgagccctggtcctgatgactgagaactggtcataagcactgagcctctatcctgctcactgagccctagtcctaatctctgaatcctgcttctgctcattgggtccttgttatcatcactcagccctggccctgggccctgttcctggtcctgaacctgtcactgactctggaccctgcgtttgcccactgctccctggggctactgctgagccctgcttcaggtcctgagttgggtcctgaacacaggcagtggccctggtcagtaacccaagctccaggtcactgcccctgtaactggtcagcgagctgaggtcagcttattcagtcctggtcccaagctcggggccactcctcagcactgattcctggtgccatccctggtccatagccctgagcccagatcctgggaaccgcaccctgggagtgatcactgatccacactcagatcactcggcactgccgggcccagttgatgacctggctcctgcttgcttaggcccagtcccagccaaggtagctttgggggagtgaatcaatggacgtatgatctttctctctctctctctctctctttctctctctctctctctcattggctcattcactgcaactgccttaaaataaatatatcattaaaagtcagcacccaagggccagcatcatggcattgagtttaactccgttgcctgggatgccagcatcccgtaggggcaccagtttctgttgtggttccaaaccagctctctgctgtgctgctgggagagcacagaagaggcccaaatgtctgggtccctgccacacatgtggagaatcagatgaaactcctggttcttggcttcagcctgacccagccccggccattgtgcccatctggggagtgaaccaaccatagtctctctggtctccctctctctgtctcggtaactctggctttcaaataaagaaacaaatcttttttaaaaataacaactccgccccatcaggatggaccttgggaataattgggtctagaatgaacctagctgagcccagcagcggccactgggacagccacacagccagcgccgccccagctgagggaagcgggagcgagccctcagatctcaggggcaaaggcgtccactcgcgcaatctcagccacagggcgtgggagcttctgccgagattcagcgagagaaagggcacaggtgcgcacacaggaagggagagttaagtgagccctgcaggagaaggcgctgcctccacacggagcgaagctgcaccaccaggcctcagggccacagccaggaggccgtcacacgaggtcagcccctgtgtgcaccgctgaccacctggctgaggaaaacacagagagagccaccccatcacaacatccgcctagaactggtcccggccccaggtccctgcccggaggaaacgaggtcagaggtcagggagaggcactgtccctgctcatggcagcactgccccagtatcaaaagccaggactcgacctaggtgtgcccggacagagactgggcaaagaacaagtgcttcctgtgcaccacgaaacaccacacaaacacatcacaaataccacacacacacacaccacgaaatacagccttcatgtaccacaaaataccacacacaaacagcatgaaataccacacatgtacaccacgaaataccacacacacatacaacatgaaatactgctgacatgtaccatgtaataccacacacacatacaccacaaaatatagcccacctatacaccacgtaataccacacacacgtacaacacgatgtacagcccacacatacaccatgaaatccacacacacagatgttcaccataaatacagcccacatcaacaggaagaactgtaaacaagtacaccctaaagtaccacccctctacactcagaaatatcatctccacgtacccctgaaaattcaccctaaattgtcatccatgtgtgcaccctgagacacccacgtgtgctccctgaggcacccacatgtgctcgctgaggcgtcgtggaccccgtgaagagccctcacctttcagagaggaaatttggtcttggccacaggtgcaggagcctggcggccaccgtgccctcaactgcgcctggcccagaggagcacgcgctccatggctctttctcacatgcaatctagagctcagggcggtatcatgggagcctgttgaggaggggaggggaacacccagggtgagaacacagtgggacaggagccccgggcgctcaggtgcggctcagggggacagcgcactgcagggcctggagtacaccagcccccgcgtcagcgccagctcagccccggctgctccgcttcctccccagatccctgctctgcgcctgggaagacggtgggtgttggctcagtgctcgggccctgcacccacgcaggagaacagagggagttctgggtggagcctgtgcctctggggttctgtcaatcaccctgtcctgcaggactcagagatgtcctgggcaggaggcggccgtgtggtcagagctccaggaacaagcgctccttggcattggagtcctggtggccaggagggctggcgactgctgctcatgggcggaggggagctgagtgtgggtttcctgggacgggaggagggtctgggtccctgtcggggtactgcaaggtggggacacagctgggtggaccctctgcctccccacggccctcacgaagtccaggctcctctggcctggccagccccgtcctctacaccgacccttcaccacccccaccctgtgcacactgcccaggggacctgaggccggggagcctggggccttcaaaggctccgtaccagccaagcttgagcagctcagccccgaagagcccgggagacacagggcagcagagccagatggacacttccggacccagtcctggcccagctgctgtgtgaccctgggctgctctttccccctctctgggccaggttctgactgtgacgaggcggggggtcctgtgctcctagggcgctctggggttgcagccacgtgcctgcggtggtctcccagcgtgctctgtgttgcggagaacgcagcccctcccagcctcttcccgctgagcctccccatgcttgtgtcaaaagggaattcacagaccgtggtcgtcagctgcttgatccgggactccttccccctgggccctctgagtgtactggaacaactgcggggagaacgtgagcgtctataacttcccgcctgcccagtctggcacttcaggcccatacaccgcatgcagcgagctgatcctaccacctgacaggtgtcctgcagatgacagtgtggcctgccacgtggagcacagtacgatgagggccagctttatagatgtgtgaaatgatagatggatagatacataatctactgatagatacataatctactgatagatacataatcagatagaataatagatacacaatctactgatagataggattcattagcagtatatgaaaaaaggttcaattccaatttaagatgagagatcaatgcctaggacctgaggacgtctggtcctctgtgctgcgggccttccgctggccatcccttagccacatttctggggcagaacagaggttctattcacaccatgatccctgctcacgccctgggcacactgaccccacactcagaccttgaggtgtgcctggtcctctctggacccaagtcacggccaaggccagcccaagagcagggcttaggcaggagccactgagtacatgactcagctcagggcagcagggccccagccacaccttccctggaccagcaaggacactgccccgcctcctgtcctgcagctgcgctaagacacttgcaggggccaaccccctatgggccctgctctcaccctcagaccccatagagaccccaccactccacccccaacccctgaggaggtatgggagggaaggccttgggccaggccccacccacacgtcaggtcctggcaggccttctgtgtcttgcaggttgtcaggagcccctgccctgtgtggtgctggatctgccacaggacagcctggaggaggaggcccccggcgccaacctgtggcccaccaccgtcaccctcctcactctcttcctgctgagcctgttctacagcacagctctgaccgtgaccagcatccggggcccacctggcagcaaagagggaccccagtactgaggcacaggtgtggggatgccctcgggaggggggaaccaggccaagcagaggtgactgctgctgccatagaggggcacatgggtccctgcaggaactgggacatgggtgccctggggtcagagtgggagcaaccccgggtgcaggagctggaattccaccaaggctcctaggagccaggcccggcctgggacaggggagagcagtgaggacaccgcccaccctcagctgcccctgtctctgcaggagggaagcgtgcaagagcccctgggaaagccagctctgcatgccagagcccagccctccatgaagcagtgaccccccatccccctgccaggtgcactcaaccctccccagatgaatgttctcgctctgctggacgatggctcagggaagccacggtggctgcagactgggggacaactgccactccaccacagggacttcagcatggactggacacggtgccccagacacggcctggccctcaggattctcaagtccaagaccagtgcttcacctgggctcaggaggacgcctccctggagtggccatggacctggtcctgagcactgggccctcatcctcgtcactgatccctggtcctgctcactgagccctggtcctgctcactgtgccctggtcctgggcctggccccatcgcacacaccaggactcctctggagctgcatcctctaaggctctgactcctttgcacacatcctgagccctgagtgctgaccgctctaggacgtgacctgcaggaaggctgcagccctcagggagtctccggcaggcaccgcttgcaggtgcagtcacggccgcactcctcatcctcactccgtcctctcaggccctgaggggttgcaggggtggagaggggacaagcccaggccccgggctgcctgaggtggactcagtgcctgcggtccccgggtcaggggtgcagcgcaggtgggaccgaggaggacgggcggtcgtgttgttttcccctgtgttgctccttcttcagaagcttcctgtgcccgtgcacctgctgaaacccctgaaatagccctgggccggctgagtcatcccaggcacagcccaggtgtccctgctgagacccctgtcctcaggccctccacggaggcctggccagattgccccgaggcctgggccaggacggccagtcccgtggggactgtggggccctcgcacccctcatgccagggtctcacgaacggcacccaccagccccagccaggcttcaggaaggccaagagctcaggttagccgggaccagcctgccttccgccagggtcagcccaggctcccctgccttccaccaggtcaggccgtctcagccaggccgtctccctggggcactgacccacagcacagcagacccacggggacccgggctagcacctgccaccgcacctcagcgtccccctgccggtgtcagggccgatgaagggcacagcctggcccagccccagcctttgcagccctctgggagggaaccagcacacacaggatctctctccttctctgtaattctgccttcaaataaataaatctttaatgagaaaacaaaagctgtgctggagcgagggcacctcacccctgctgagcgagcacagccccccccccccccgggcccgcagccaaagccccgctctgctcagagcaccagctccactgatctcaagtgatcccgggaaggatctcacggggacgccgctgtgggctgcgggtcaggggtcccagcaccccgtgggctccaggctgcaaccagcaggggaagggcagcagcacagcccccacccccacccccacaacatacgccactctgatggaagagtgaccgtgagcaaagccattaaacagagccaatctggaaaaattctgcccccccccagactggctcccactccctccctccgccatgggcaggcagtgctgagacccaaaaggacaggggcccagtgacccagcagggagacagcaaggcccactcctgcctcagggtcccgcctagcatacagggactgagccctgcccgggtccaccctgaggacatgggccgagcgaggccagcaggacccacctccaaccctaccatctgcccggggcccttcccccaccacagctgcaggaggccagcccactgcttcacagggaggctgttgttgagggctcctcccgcccatggaccccgtcctccacacacagggatgagctcaggacgcccactgcagctgacgacttggcaacaccgtcatagcccggccccttgctcccacggacgcccacggagtgcagaggccatccgggctgaccatttaccctgcaacaggcgctcagtggagctctggaagcctggaggagggtctcgggcacaggtgtccatgaagtgcagcctctgcagctgagacccagcctgcgaggagttagcacggagcctccccacaggaggagggtccacgtctctggggtcacagcccagacaaaccccaagcagatgagactgtctttgttctacactggcctgctttggtcccagagcacaaggccaccagaccagcccggggaacagtgtccagcctcaggctgcggccgccccagaccactccccgccctgcgtcctgggtcatggcacagcccaggctgggagcaggagtgtggcacagcaggtgaagctgcctcgggacacccgcagcccacatgggagcacctggggtcacggcctggctccgcctccgattccagcttcctgctgacctgcacctgggaggcagcagtgaccactccactcctgggccctgccacccacaagccagacccaggctcctggcttccgcctgcccagtcccggctcttgtgggcctcggggagccaaccagcaggtggaagatcttcctctctctcttcctccctctctgccgccctcccgtgaggacagacgaaaacaaacgaggccagcagttgtgggagagcccctgtcccccccagggccggcgcctgtgctcccgtggcagagctggccgtggaggggctgttccctgtggaggacggcccaactgtgtcactcggcaaaccctgatcccaccgggcggtgtcggggtcaccagggtgcagcccacagtgggatccctgccttaggaaaagcacccagcgtgacctggctcctctccctgccaggggacggcacctgcagtgatcttcctctgtgcagatgaggacacccagggtgagcttgctctccctctctctgcctctctctccctctctctctccctccctctctctctctccctcccctccacccgaggtgtggacactgggagaagaccccgccctgacgctggctccagcctgcagaacggggagaaatcagtgccttctctgaagcctgcccgtctgcgctgtgtttgctgcagccatcagcaatgcctaagacgcacggccacgaggtccccgcactgagagtgcggccgtcacaacacctgccgagctccctgtggccaggccagggcacatctgccgggaccctgggccacaccacaacctagcctgctgacctggccctgcacctcccaggctcgccgtgctgcctctgtggccagggggcttcaggtcacccacatttcaaaagacactgccaggactgcctctgggtagaccccagcccagccaacccacacctgtggagcctgggcaggtgtgtgcagcccatgctagcttacctgctgctccccatcccctcctgacccggacttccctgggtgaggactgtgggtacctgaatgtggctgtggaaccccaaggacagaggacctggtacagcaacgctgacagtgcagcccagagagagatggggtgggggactggggtggatgcagggaacccaggccaggaagagcatcgccctctgcctgccacaggccagagaccccgagtgggagaaggcagagctggaactgcaggggattcagtcagctgtctgtggggctgacaggtgcagggaggccagacccatggctcaatggctgtccccaccctgacaccaaccctgaggccccaaaggcagccctgtcccctgagccctggccctcccatgaatggggccttctcttggcctgggctagcactccctgctctccgtctccacccctgtcccagtgtctctgagactctgtgtccatttgggcctctccttcccgaatctcagcccccagcccatcgtgtggccagcaacatgaaactctggtccctccatggtccctggggtcacagggcccaaacctcacacacctgttcccaacacagacagaccacagaccagacatgatgcagaggccagctgcattgtctgctggaacaggaagcaggcagctgagtgaccccaacatggggccagacccacagtcacgcaaccctctccagcctgcactcagcagccagccccagcccagccatggacaacgagccagagcaggtgcacagctctccaggagggcccggaccaggcctggctcccactccactcggcccctctgggccagcagcagagggtgcaggtaaggagctctggtcaggcgtggatccgcagtgcagggcagcctggccagggagacctgaccctccacggtgctcctccagcagcccagacaggtgggtccacggggctctgcccctctgcacaggggcagtcacagccaggctggtcctgaggctcctggggacagagggagaacaggcatcagccaaagaagggagggaaagggagaccacagccaggagcccagcgaccacaggcaggacacagccactggccgggagaggctgggacagggggctgagcccggcagagcccaactcagtcaggatgagccgaggccctgggaggcagtgccaagagccctgcaggctgatctagacgtgggctgggttgggacagagatgagcagaggaggatgtgggaacctgatggacgcccacactcagctgaactggactgggctggaataaaagggtagggtagggtcgggctgagctgggctgagctgagctggactggtttgagcacggccaaactggactgcaataaatgggctggatttgccttgctcagctgatgtaagcagggctaagctgatctgggctgaagctaactttggcttggatgggctgtgcggggctgagttggtctggactgagctgagctgagctgtgcagagatgacctgggcagagctgagctgggctgggctgagctgaccttggctttgatgggctgagatgggctgggctgggctgggctgggctgagctgggctgggctggactggactgggctgagctgagctgagctgagcttgtctgggctgagctggctgggctgacctgggctggaatgggctggcttgaaccaggcagagtgtgctaagctgatttggacagagctgtgctcagcttagctgggcagagctaggcagagctgggcagagctgagatgggctgggctgagctgacctggacagagctggactgggctgggctgagctgagctgggctgagctgggctgagctgggctgggctgggctgggctgggctgagctggacagggctgagctgagctgagctggtctgggctaagctggctggaatgggctggcttgaaccaggcagagtgtgctaagctgatttggacagagctgacctggacagagctgggctgggcttggctgagctgggctgggctgagtttagttgtgctaaactgggctgagctgggttgggcttacccgaattgggagctgggatgaacagggcatagctcggctgcgcagagctggactgggccaggctgggctgagctgagctgggctgggcataattggactgggttgagctgggcagagctaggctgagctgagctggcatggcatgggctgggcagagcttggctgggctgggctgggctctgttgggtagaggtgtcctttgcagggctgggctgccatgggctggctgagctgggttgagctgagctgagctgagctgggcagagctgggctgagctgaattgggctgagctgggctgactgggctgggttgagctgggctgagctgggctgagctgggctgagctcagctgagcttggcagagcttggcctgagctgacctcagctgagctaggctaaactggcctggcatggactgggcagagctgggatggactgggctgagctgagatgagctgagctgagctgggttggacagagcttggcagagttgggctgggctgggctggtctgagctgatctgggctgacctcggcagagctgggcagagccggtctgggcacaactgggctaggttgagctgagctgggctgacctgggctctgctgggctggcctgagcagagctgagctgaccttggctttgatgggttgaggtgtgttgggctgggatgcactgagctgatctgggctggaccgagctaagctgggctgggctggattgaactgggcagagctgagctgagctagactgagctgactagggctgagctggattgaactgggcagaactgggctgaactgacctgacctggactgagtggagtgagctggtgtagactgagctgacctgggctggactgggctgggcagagctgatcttggcctgtatgggctgagctgggctgagctgagctgacctctattgagctgagctggaatgggctgggcagagcttacttggctttgatgggctgtgctgaactgggttgagctgatctgggcatggctaagctgggctgccctgggctgggctgagctgatctggtctaggatgagctgggctgagcagagctgggctgggatgaagtggcctgggctaggctgggatgagctggcgtagactgagcagagctgggctggactgggttgtgcagagctgaccatggctggtatagactgagctgggacgagtctagcttgctgagacaggctaaggttatgtgacctgggctgggctaagctgagcagggctgagttgtgctgggctgagctggactaacctggacttgagctggaatggactggactgggctggactaattgagatgaacagtgtcttctgcactctctgggaaataccaaatatgtgtctgaggctgagcttctttctgaggtactggggaaaggcaaggccagagcccatggtgcagccaaacaagacctgtgctcctagggcggagcctgtgcctctgggcgctgtcggtcacccctgtcctgcaggactcagagacgtcctgggcaggaggctgctgtgtggtcagagctccaggaacaagcactccttggcattgggagccctggtggccaggagggctgtcgactgcggcttcatgggggaggggtgccagtgtggggaccatggggccgggcgagggtctgggatcctgacaaagaaagtgcaaggtgggcacagagctgggtggaccccctggctccccacagccctcaccaagcccaggctcctccggcctggacaggcccttcctctacacccacccttcagcaccccaacctgtgcacactgcgcagagaagcctaaggccctgagagcctggggcctgcgatggctcagtgccagccaagcacagtctagaggagcttgggagacacagggcagcaggagccagctggacacttcaggccctggtcctggcccagctgctgtgtgaccctgggctggtctcctcccctctctggatgaggttccacacagaggcggcaggcgatgtcctatgttcccagggctctctggggttacagccatgtgactgggatggtttcacaatgagtcttgtgttgcaga

SEQ ID NO: 90 - DNA, 137 bp, Oryctolagus cuniculus
gtcagaggagagctgggggagggggcatgaggctgcagagtgggctgcgggctggaccacaaagctagaacagaggacaacctagataagcaattaaagaaagggcactgaaactccgtcttctctgttccatcagc

SEQ ID NO: 91 - DNA, 180 bp, Oryctolagus cuniculus
gtgagcctgaccccacccccaggcaataggctgctctcctcaccctggcctgactcctccctccccaccctgggggctgaggctccctccccaggtcacagagggaaactgaggccagcgttcgtgacaatggagctcggtacttcactaccgccctgaccccactctcccccttccagg

SEQ ID NO: 92 - DNA, 2205 bp, Oryctolagus cuniculus
gcccctggcctgccctgaataaactccatgctcacccccagcagccctgcgggttcattgtgcctgtctgtctcctcgggggctgcagccacagggcagggagggggagcgaccctggtccaaggagttggggcttcgggtacctggtggggacatcatgcatggtgcccgtgagtgtgcatgtgagtgtgagtgtgagcaaggtgcctgtgggaatgagtgtgcctgggagtgagtgtgtagggagtgagcgtgtctgggagtgagtgtgcctgggagtgagtgtgtctgggagtgagtgtgtaaggagtgagtgtgtctgggagtgagtgtgtctgggagggagcagtgagaggggaggctgagccggggtggattctgaggcagtgcaggcacagctcaggtcgcacccagagccgtggacaccaccaggagttcctgggcagcagggatgcagccattgccctggtgcagaggacgagggagggagggagggggaaggaacaggggctgggtgcagggacccccgggaagaggggacccacaggccccccagaccggcagaggtcagcccagggcaacatcgcccagtagtgcaggacagtactgacatacacaggggacacagcaggccccaccccgcaccacactctgtggcatgcacacggcacacgtgctcacagggcacacacactcacacacgtccccctcagctgcaggagagctcacagcccagacccagctctaggaaggcaaggttgtctccgcccaagccccagacggtttccccagaccaaccctgctgcccagggctcagctggccctctctgggtctccttgatgtccagccatgcacagctcttagagtagttctactgcccaccctaggcaagccctgcttccagctggccccagacttaaccctctaatcccctcctgagcccaagtctgatcaaaccacaggcagagaggggcaggacagagaccacccacacaggcccctcttcaggcctcaagcttctgattctcaccccaggagctcccaaacaaatttaagaacaccgggcaccaggacgcacaaaaactgggatcttaatcttgccctagatgcttttggggcctcctaggggctctgattatggccgcctcccttgtcagggcccaggtgaagaggagccccacacacagccacttcatccccagagggtcacatccaaaagagctgcaagagaacaggccaggcagggaaatggtacccacacaagtaccccagccaccccatgggcccaggaacttagtcaaaggagaagctttttttttttttttttttttttttttttggacaggcagagtggacagtgagagagagagatagagagaaaggtcttccttttccgttggttcatcttccaatgtccgttgtggttggcatgctgcagccggcgcaccacgctgatccgaagccaggagccagatgcttctcttggtcttccatgcgggtgcagggcccaaggacctgggccatcaagacagctttctaaggaaagagagaaaggggaagaattatcatggatagcagacagataagccaatgaccataagacatagtggaccatggatggatggatggaaggacactagatagatggaaaacaatagatggaaggatcagtggaaggatggacgatagctatgtagatgggacaagcggtggataaatagataactattgcttagatgacgatagataattatagattagattgatgtaccagtgcagggcaaacaagatcaactccaatttgagatgagagatcaaacctaggacctgaggacgtctggtctgctgtgctggctgctggctgctggccttcgctgaccgtccctcagccacttccctggggaagaacagaggctctgctcacaccatggtccctgctcatgccctgggcacactgatccccacactcagaccttgaggtgtgcctggtcctctctggacccaggtcccggccaaggtcagcccaagagcagggcttaggcaggagccactgagtacatgactcagctcaggccagcagggctccggccacaccttccctagaccagcaaggacactgccccgcctcctgtcctgcagctgcgctaagacacttgtaggggccaaccccctatgggccctgctctcgccctcagaccccatag

SEQ ID NO: 93 - DNA, 9448 bp, Oryctolagus cuniculus
gcccctggcctgccctgaataaactccatgctcacccccagcagccctgcgggttcattgtgcctgtctgtctcctcgggggctgcagccacagggcagggagggggagcgaccctggtccaaggagttggggcttcgggtacctggtggggacatcatgcatggtgcccgtgagtgtgcatgtgagtgtgagtgtgagcaaggtgcctgtgggaatgagtgtgcctgggagtgagtgtgtagggagtgagcgtgtctgggagtgagtgtgcctgggagtgagtgtgtctgggagtgagtgtgtaaggagtgagtgtgtctgggagtgagtgtgtctgggagggagcagtgagaggggaggctgagccggggtggattctgaggcagtgcaggcacagctcaggtcgcacccagagccgtggacaccaccaggagttcctgggcagcagggatgcagccattgccctggtgcagaggacgagggagggagggagggggaaggaacaggggctgggtgcagggacccccgggaagaggggacccacaggccccccagaccggcagaggtcagcccagggcaacatcgcccagtagtgcaggacagtactgacatacacaggggacacagcaggccccaccccgcaccacactctgtggcatgcacacggcacacgtgctcacagggcacacacactcacacacgtccccctcagctgcaggagagctcacagcccagacccagctctaggaaggcaaggttgtctccgcccaagccccagacggtttccccagaccaaccctgctgcccagggctcagctggccctctctgggtctccttgatgtccagccatgcacagctcttagagtagttctactgcccaccctaggcaagccctgcttccagctggccccagacttaaccctctaatcccctcctgagcccaagtctgatcaaaccacaggcagagaggggcaggacagagaccacccacacaggcccctcttcaggcctcaagcttctgattctcaccccaggagctcccaaacaaatttaagaacaccgggcaccaggacgcacaaaaactgggatcttaatcttgccctagatgcttttggggcctcctaggggctctgattatggccgcctcccttgtcagggcccaggtgaagaggagccccacacacagccacttcatccccagagggtcacatccaaaagagctgcaagagaacaggccaggcagggaaatggtacccacacaagtaccccagccaccccatgggcccaggaacttagtcaaaggagaagctttttttttttttttttttttttttttttggacaggcagagtggacagtgagagagagagatagagagaaaggtcttccttttccgttggttcatcttccaatgtccgttgtggttggcatgctgcagccggcgcaccacgctgatccgaagccaggagccagatgcttctcttggtcttccatgcgggtgcagggcccaaggacctgggccatcaagacagctttctaaggaaagagagaaaggggaagaattatcatggatagcagacagataagccaatgaccataagacatagtggaccatggatggatggatggaaggacactagatagatggaaaacaatagatggaaggatcagtggaaggatggacgatagctatgtagatgggacaagcggtggataaatagataactattgcttagatgacgatagataattatagattagattgatgtaccagtgcagggcaaacaagatcaactccaatttgagatgagagatcaaacctaggacctgaggacgtctggtctgctgtgctggctgctggctgctggccttcgctgaccgtccctcagccacttccctggggaagaacagaggctctgctcacaccatggtccctgctcatgccctgggcacactgatccccacactcagaccttgaggtgtgcctggtcctctctggacccaggtcccggccaaggtcagcccaagagcagggcttaggcaggagccactgagtacatgactcagctcaggccagcagggctccggccacaccttccctagaccagcaaggacactgccccgcctcctgtcctgcagctgcgctaagacacttgtaggggccaaccccctatgggccctgctctcgccctcagaccccatagagaccccaccattccacccccagcccctgaggaggtgtgggagggaaggccttgggccaggccccacccacacgtcaggtcctggcaggccttctgtgtcttgcaggttgtcaggagcccctgccctgtgtggtgctggatctgccacaggacagcctggaggaggaggcccccggcgccaacctgtggcccaccaccgtcaccctcctcactctcttcctgctgagcctgttctacagcacagctctgaccatgacaaacatccggggcccagctgccagcaaagagggaccccagtactgaggcacaggtgtggggatgcccagggaaggggggaaccagcccaagcagaggtgactgctgctgccatagaggggcacacgggtccctgcaggaactgggacatgggtgccctgggtcagggtgggagcgtccccaggtgcaggagctgaggattccaccaagctcccgggagccaagcccggcctggggcaggggagaggggtgaggacaccgcccaccctcagctgcccctgtctctgcaggagggaagcgtgcaggagcccctgggaaagccagctctgcatgccagagcccagccctccatgaagcagcggaccccccatccccctgccaggtgcactcaacccttcccagacgaatgttctcgctctgctggacgatggctcagggaagccacggtggctgcagcctgggagacgcctgccactccaacacagagacttcagcatggactggacgcggtgccccacacatggcctggccctgcagtaggctcaagtccgagaccagtgcttctcctgggagggcgcaggaggacacctccctggagtagccacggacctggtcctgagcactgagccttggtcctggtgactgaccctgtttcaggttactgagccctggtcttgctcactgtgtcctgttcgtgtactcatatttggtctggtactgacccttggtcatgttcactgaacccttttcctaagcactgacacctggttctcctcactgggccctggttctcgacgcggtgacccagacaaggcctggccctgcgggaggctcaagtccaagaccagtgcttcacctgggctcaggaggacgcctccggggagtggccatagaactggtcctgagcactgggcccttgtcctcgtcactgagctcttgtcctcatcactgagccctggacctggtcactgatccatggtcctgctcactggcccctggtcctgatctctgagccctagtcctgagcctgggcctgccccatcgcacacaccaggactcctctggagctgcatcctctaaggctctgactcctttgcacacatcctgagccctgagtgctgaccgctctaggacgtgacctgcaggaaggccgcagccctcagggaggccccggcgggcaccgcttgcaggtgcagtcacggccgcactcctcatcctcactccgtgctctcaggccctgaggggttgcaggggtggagaggggacaagcccaggccccgggctgcctgaggtggactcagtgcctgtggtccccgggtcaggggtgcagcgcaggtgggaccgaggaggacgggcggtcgtgttgttttcccctgtgttgctccttcttcagaagcttcctgtgcccgtgcacctgctgaaacccctgaaatagccctgggccggctgagtcatcccaggcacagcccaggtgtccccgctgagacccctgtcctcaggccctccacggaggcctggccagattgccccgaggcctgggccaggacggacagccccgtggggaccgtggggccctcgcacccctcaggccaggggctcacagacggcacccaccagccccagccaggcttcaggaaggccaagagctcaggttagccaggaccagcctggcttccgccagggtcagcccaggccccgctggcttccaccaggtcaggccgtctcagccaggccgtctccctggggcactgacccacagcacagcagacccacgggacccgggctagcacctgccaccgcacctcagcgtccccctgcccatgtcagggctgatgaagggcacagcctggcccagccccagcctttgcagccctctgggagggaaccagcacacacaggatctctctccttctctgtaattctgccttcaaataaatgaatctttaacgagaaaacaaaagctgttctggagcgagggagacgcacccctgctgagcgagcacagccccacccccccaccagggcctgcagccaaagccccactctgctcagagctcctgattgaggctcctggagggatctcacagggacgctgctgtgggctgcgggtcaggagttctgggaccctgtgggcccagagctgcaaccagcaggggaagggcagaagcacagacaccctcaaactacaccactctgatggaagtgtgaccttgagggaggccactaaatagagtcgatctgaaaaaatctctgcccaccccaccagactcactccccactccctcccaccgccatgggcaggcagtgctgagacccccaggacaggggcccagggacacagtagggagacagctagggctactcctgcctcagggtcccaccaggcagccagggaccagggacggagccctgcctcggtccaacccgaggacatggggccgagcaaggccggcagggcccgcctccagccccaccttttgccccagcccttcccccaccagggctgcaggaggccggtccactgcttcccatggaggctgttgctgagggctcctcccgcccatgggccccgtcctccacacacaggaatgagctcaggacacccactgcagctgaggacccagcgacaccgtcatagcccagcccctactccacggacactcacggagtgcagagccaatccaaggggaccactctccccgccccagccactcactggggtctagatacctggaggagggtctcgggcacaggtgtccatgaagtgcagcctctgcagctgagacccagcctgcgaggagttagcacggagcctccccacaggaggagggtccacgtctctggggtcacggcccagacaaaccccgagcagatgagactgtctttgttctacactggcctgctttggtcccagagcacaaggccaccagaccagcccggggaacagtgtccagcctcaggctgcggccgccccagaccactccccgccctgcgtcctgggtcatggcacagcccaggctgggagcaggagtgtggcacagcaggtgaagctacctcgggacacccgcagcccacatgggagcacctggggtcacggcctggctccgcctccgattccagcttcctgctgacctgcacctgggaggcagcagtgaccactccactcctgggccctgccacccacaagccagacccaggctcctggcttccgcctgcccagtcccggctcttgtgggcctcggggagccaaccagcaggtggaagatcttcctctctctcttcctccctctctgccgccctcccgtgaggacagacgaaaacaaacgaggccagcagttgtgggagagcccctgtcccccccagggccggcgcctgtgctcccgtggcagagctggccgtggaggggctgttccctgtggaggacggcccaactgtgtcactcggcaaaccctgatcccaccgggcggtgtcggggtcaccagggtgcagcccacagtgggatccctgccttaggaaaacacccagcgtgacctggctcctctccctgccaggggacggcacctgcagtgatcttcctctgtgcagatgaggacacccagggtgagctcgctctccctctctctccctctccctctccctctccctctccctctctccctctctccctctctccctcctctggcttcctccctctccccccacccaaggtgtggacactgggagaagaccccgcctgacgctggctccagcctgcagcactgggagaaatcagtgccttctctgaagcctgcccgtctgcgctgtgtttgctgcagccatcagcaatgcctaagacacacggccacgaggtccccgcactgagagtgcggccgtcacaacacctgccgaggtccttgtggccaggccagggcacatctgccgggaccctgggccacaccacaacctagcctgctgacccaggccctgcacctcccaggctcgccgtgctgcctctgtggccagggggcttcaggtcacccacacttcacaaaaaactgccggcctgcctctgggtagaccccaggactcagcccagccaacctaggtcctgtggagtgtgggcagggtgtgcagctcctactggctcacctgccactccccgctccctgcccgacccagccctccctgggtgagaaatgtgggcactgagtgtggctgtggtaccctaaggacagaggacctaggacagcaatgctgactggcagcccagagagagatggggtgggggactggggtggatgcagggaacccgggccaggaagagcatcgccctctgcctgccataggccagagaccccaagtgggagaaggcagagctggaactgcagggggttcagtcagggatcccagctgtctgtggggctgacaggtgcaggggcgttaggcccacagcacaatggctgtccccaccctgacatcagccctgtggtcccaaaggaaaccctgtcccctgagacctggccctcccatgaatgaagccttctctcggcctgggctagcactccctgctctccgtccccatccctgtcccagtgtctctgagactctgtgtccatttgggcctctccttcctgaatctcagcccctaaccccgtcctgtggctggccacatggagccctggtcccaccatggtccctcgggtaacacgccacacacatacctgtccccaccacagacagaccacagacaagtatgatgtggagatgagctgcactgtctactgggataggaagtgggcagctgagtgaccccaacgtggggccagacccacagtcacgcagccctcaccagtcacactcaacagccagccccagcaaagtcatgggcaaagagccagagcaggtgcacagctctccaggaggggccctgactagggctggttcccactccactcagcccctctgggccagcagcagagggtgcagatggggagctctggtcaggcgtggacccgcaatgcagggcagcctggccagggagacctgaccctccatggtgctcctccagcagcccagacaggtgggtccacgggactctgcccctctgcacaggggtagttgcagccaggctggtcctgaggctcctgggggcagagggagaacaggcatcagcacagagggcagggagagggagaccagggccaggagcccagcaaccacaggtaggacacagccactggccgggagaagctgggacagggggctgagcccagcatagcccatcccagtcaggatgagccgaggccctgggaggcagtgccaagagccctgccggctgatctaaacgtgggctgtgctgggacagagatgagcagaggaggacatggggaacctgatggacgcccaccccctgctgagctgggctgggctggaataaaaggataagttctggctgagctgagctggactgagctgagctggactgaaatgagcacagctgaactgcactgcaataatgggctgggttgggctgggctgagctgggctgagctgggtgaaggtaacctgtgctggcctgggctgggataggctgggctgagctgaccttggctttgaggggctgagctgggctgggctgggctgagctgagctaagaagggctaagctgaccttggctgtagagacacgagctactttgacctggatgggatgagcagggcaaagttgagctggactgagatgagctgagctgggcagaggtgacctgtgctaacctgggctgtgtttgggctgagcatggctgggctgagtagggctgagctgggctgagcagggctgagctaagctaagctgggatgatcagagctgggctgggctgtcctgggctgagctgaccttggctttgatgggctgagctgggatgaacagagctgggctgagctgggctgagctgggatgaacagagctgggctgagctgggctgggctgagctgggctgagcagagctgggttgagctgagctgggctgagctgggatgagcagagctgggttgagctgagctgggctgagcaaggctgagctgggctaagctgggctgagctgagctgagctggcctgggttgagctgggctgagcaggactgagctgggctgagctgagctgggctgagcagggctgggctgggctgggctggactgaactgagctgggatgagccgagctgggctgggctggtctgagctggtctgagctgaccttggctttaatgggctgagttgggctgagctgggtttggctgacctgggctgacctgagctgagctgggatgagccaaggtgggctgagttgggctgggctgggttgagctgggatgagcagagctgggctgagccgggctgggctgagctgggatgagccgagctgggctgagctgggctgaactgagctgtgcttagctgagctgggctgagctgggctgagctgggctgggctgggctgagctgagctgggatgagcagagctgggctgagctgggctgggctgagttgggctgagctgagctgagctgagctgtgctgggctgagtagggctgagctgggctgagccgggctttgctgagctgagctaagctaagctgggatgatcagagctgggctgggctgtcctgggctgagctgaccttggctttgatgggctgagctagtctgggctgagctgatcttggctttgatgggctgagctgggctgagctgagccaggctgagctgggctgagcagggcttgaactgggttgggccggcctgggttgggcctagctgggctgagctgaccttggctttaatgagctgagctgagctgtgctctgcttctctgagctgagctgagctgggatgagcagagctgggctgggatgagcagagctgtgttgagctgggctgacccgggctgagcggagctgagctggtgtagattgggctgacctgggctggactgggctaggcaaagctt

SEQ ID NO: 94 - DNA, 828 bp, Oryctolagus cuniculus
agctctctgctgtggcccgagaaggcagtggaggatggaccaagtgcttgggccttgcacccacatgggagaccgggagaggcatctggctcctggctttgaaacagtgcagtacgccagccacagcggccactggggagtgaaccaatggaaaaggaagacctttctttctgtctctctctctctctctcactgtccactctgcctgtcaaaaaaaaaaaaaaaaacagaggctctgctaacaccatggtccctgctcacgccctgggcacactgacccccacactcagaccctgaggtgtgcctggtcctctctggaaccaggtcccggccaaggccagcccaagagcagggcttaggcaggagccactgagtacgtggctcagctcaggacagcagggccctggccacacctcccctggaccaggaaggacactgccccgcctcctgtcctgcagctgcgctaagacacttgcaggggccaacccaatatgggccctgctctcaccctcagaccccatagagaccccaccactccacccccagcccctgaggaggcgtgcgagggaaggcctggggcccaggccccacccacatgtccaggtcctggcagcccttctgtgtcttgcaggttgtcaggagcccctgccctgtgtggtgctggatctgccacaggacagcctggaggaggaggcccccggcgccaacctgtggcccaccaccgtcaccctcctcactctcttcctgctgagcctgttctacagcacagctctgaccatgaccagcatccggggcccacctggcagcaaagagggaccccagtactga

SEQ ID NO: 95 - DNA, 7325 bp, Oryctolagus cuniculus
  misc_feature (3694)...(3703): N=A, T, G, C
gcggatgaatggcagaaattcgatgataagctgtaaacatgagaattggtcgacggcccgggcggccgcatacgatttaggtgacactataggatccgtgacccaggacctaggacgtccggtccactctgctggctgctgtgctgctggccttcgctggccgtccctcagccacattccctggggaagaacagaggctcttgctggcgctgcggctcactaggctaatcctccacctgcggcactggtaccccgggttctagtaccggtcggggcgccggattctgtcctggttgcccctcttccagtccagctctctgctgtggcccgagaaggcagtggaggatggaccaagtgcttgggccttgcacccacatgggagaccgggagaggcatctggctcctggctttgaaacagtgcagtacgccagccacagcggccactggggagtgaaccaatggaaaaggaagacctttctttctgtctctctctctctctctcactgtccactctgcctgtcaaaaaaaaaaaaaaaaacagaggctctgctaacaccatggtccctgctcacgccctgggcacactgacccccacactcagaccctgaggtgtgcctggtcctctctggaaccaggtcccggccaaggccagcccaagagcagggcttaggcaggagccactgagtacgtggctcagctcaggacagcagggccctggccacacctcccctggaccaggaaggacactgccccgcctcctgtcctgcagctgcgctaagacacttgcaggggccaacccaatatgggccctgctctcaccctcagaccccatagagaccccaccactccacccccagcccctgaggaggcgtgcgagggaaggcctggggcccaggccccacccacatgtccaggtcctggcagcccttctgtgtcttgcaggttgtcaggagcccctgccctgtgtggtgctggatctgccacaggacagcctggaggaggaggcccccggcgccaacctgtggcccaccaccgtcaccctcctcactctcttcctgctgagcctgttctacagcacagctctgaccatgaccagcatccggggcccacctggcagcaaagagggaccccagtactgaggcacaggtgtggggatgccctggggaggggggaactgggcccaagcagaggtgactgctgctgccatagaggggcacaagggtccctgcaggaactgggacatgggtgccctgggtcagggtgggagcgtccccgggtgcagcagctgaggattccaccaaggctcccgggagccaggcccaggctgggacaggggagagggtgaggacaccgcccaccctcagctgcccctgtctctgcaggagggaagcgtgcaagagcccctgggaaagccagctctgcatgccagagcccagccctccatgaagcagcggaccccccatccacctgccaggtgcactcaacccttcccagacgaatgttctcgctctgctggacgatggctcagggaagccacggtggctgcagcctgggagacgcctgccactccaacacagggactcagcatggactggacgcggtgccccagacacggcctggccctcaggaagctcaggtgcaaatccagtgcttccgtccagcgccgtggagctctaggttgatcctccacctacagtgctggcatcccttcggcgccgcttctagtcccggttgctcctcttccaatcagctctctgctgtggcctgggatagctgtagaggatgatccaggtccttgggccctgcacccacatgggagaccaggaggaagcacctggctcctggcttcagatcggcgcagcgctggccattgcagccatctgggaagtgaaccaacggaaggaagacctttctctctccctctctctctctctctctctctctctctctcactgtctgtaactctacctctcaaatgaataataaaaatcttttaaaaaaaatccagtgtttcacctgggagagcattaggaagtcaactccatggaagtgtcacggacttggtgctgcacacttggtcctcgtctttctcactgagccctggtcctgatctctttgacatggtcctgatctctgagccctggtcctattatctgattcctggtcttgatgacctaatgtggtctggatattgggccctggtcatgacattgagccctgtcctgagtactgtgcctttgtcctcgtcactgatccctggtcctgagcactgggccctggtcctggtcactcatctttggtctgatgactgtgccctggtcctgctcactaagccacaatcctgagctctgaacccaagttctagtcactgggccctggttctggtgtctgatccctgatcctgctcactgaggccttgtcctgagcactgattcctggttctgatcactttgccctggttctactcactcagtcctggacctgggccctgcacctgtcctgacgctgtcactggttacagctccccgcccctgagttctggaccccgcgtttgcccactgctccctggggctactgctgagccctgcttcaggtcctgagttgggtcctgaacacaggcagtggccctggtcagtaacccaagctccaggtcactgcccctgtaactggtcagcgagctgaggtcagcttattcagtcctggtcccgagctcggggccacccctgagcactgattcctggtcgtaaacgctggccacaccatccgcactcctcctgctgtctgcctgctccccaaggcctccagaccctgcggctgcacacctggggcccctgatgctccagacccaggcctcaccagtgctgccacggcaaccacgaggacccgggctgcttcctgctcagggcagcctctgccgcggagccatggcccccacaggacacgaagtgcagcagctcccacagctgttccttccccgggagccgccttccggtaagattccagctgtgcctgggctggaggggtgggcctgagtgggcacccgtggcagccttgccgtcaaactggcctccatggaaacgcatatgaactcatcgtgagaccccaccttgtaatatcagggtggccctgtccaaaagagcaaagctaagtgttagggaggaggtggagccaagggactccttgcatgtggctggcaggagtgtcaattagaacagccgcgtgcagagcatatggttgtctcgcaaacaactggtcctgttcccaggtccttacctgaaggaaatgaggtcagaggtcagggagaggcgctgtcccctactctcggctgcacttcccccagtagcaaatgccaggactcgacccaagtgtgcacggacagagactgggcaaagaacatgtgcttcctgtgcaccacgaacaccatcactacacacaccacgaaataccacacacacacacaccatgaaatacagcccacatgtaccacgaaataccatacacactgtgaaataccacgcacatgtacaacatgaaatacagctgacgtgtatatcacaaaatagcacacacacatacaccaggaaatacatcccacatgtacaccatgaaataccacacacatacaccatgaaataccacatacatgtacaacacaaataccacccacacatgcaccatcaaatacagtcaacannnnnnnnnntaacatgtacatcatgaaatagcacacacaatacaccatgaaatacacccacatgtacaccatataacaccacacacacatacaccatgaaatatgcccacatgtaccacgaaataccacacacacacacagcatgaaataataaacacaccattaaatagaaatgacatgtatgctgtgtaataccacacatgtgtacacaaatacagcccacatgtgaacagtgaagaactgtaaacatggacaccctggaataccgtccgcgtgtgcaccagaacagcacccagagcaacctcgcaccctctctatccacgcgaggcacacagagtgatctctctctctctcgctctctcgctctctccacatgggccatccagattaatctctggctcaccctctctctctctccaggagtgcacactgggagaatcccctccctgacgccggcctccagcctgcagacctgggagaaatcagtgccttctggcgaagcctgctcgtctgtgctgtgtttgttgcagcagccacaaatgactaagacgcacggccacgaggtccccatgcactttccctgcatctcagcccccagcccgtcctgtggccagccacgtggagccctcatccctccctggtccctgaggtcccagggcccaggctacagacacctgtccccaccacagacagaccacagaccagacatgacgtggaggcaagcagcactgtctactgggacaggaagtgggcagctgagtgaccacaacgtggggccagacccacagtcacgcagcctccccagcctacactcagcagccagccccagcccagccatgggcaaagagccagagcaggtgcacagctctccaggagggcccggaccaggcctggctcccactccactcagcccctctgggccagctgcaaagggagttgatggggagctctggcccagagtgtggacccgcagtgcagggcagcctggccagggagacctgaccctccatggtgctcctccagcagcccagacaggtgggtccacgggatgctgcccctctgcacgggggcagtcgcagccaggctggtcctgaggctcctgggggcagagggagaacaggcatcagccaacaagggcagggagagggggaccacggccaggagcccagtgaccacaggcaggacacagccactgctggtaaaggctgggctcggggggctgagcccggcagagcccaactcagtcaggatgagccgagtccctggaggcagtgccaagagccctgcaggctgatctggacgtgggctgggctgggacagagacgagcagaggaggacgtgggaacctgatggacgcgcaccccctccttgaactgggctgggctgagctgggcttggctgtgctggcctggactgagctgagtcctgcagagctggattgtattaaatgggctgagtgggactgagctgcggtgaactgggctgggctgagctgggctgggctgggctgagctggttgggttggactgagctctgagctcggctgggaggggcagggctggggtgggttgggctgaactggactatgcttggctgaactgggtttgactgggctgagctgggctgagttaggctgagctgggctgggctgggctgggctgggctgggcttagctgtcctaggctgaactgggccaggctgggctggactgaggaggttgagctgggctgggctgagctatgctaggatgggctgggccgagctggcctggacatggttggcctaggctgggctggaatgggctgacctgtgctggcctgggctgaactgggcttgaccaggctgagctaggctgagctgggctaggctgggctgggctaggctgggctaagctgggatggtcaaggttgggttgggctggactgagctatgctgagctgggttaagctggaatggacaggctacctgggctgggctgagctatgctgggctgggctatgatgaactaggcagagttgaactgggctgttctggggtggattgggcaggctgagctatgctaggatgggctgggtgagctggcctgtcagggttgggctgggctggacaaagctgagccctgcagagctggattacaataaatgagctgagctaggcaaagctgagctgggcttggggggcagggggcactgagttgatctgggctgggctgggatgagctggactgggctgggatggattgacatgaattggattgaacttaactgggctgggctggggtgggttgggctgaaatacctgggcagggctgggctaggctgaactgggattgactaggctgagctgggctgagcagaaatggtcaaggttggcttggactgggctgagctatgctgagctgggttgagctggaatggacaggctacctgggctgggctgggctgagctatgctgggatcagctgggatggactgggctgggctgggattacctgacttaggctgaactgggccaggctgggctggactgggcaggctgagctgggctgggctgagctatgttagatgggctgggtggaagggctgaactgggctggcctggactaggagagtgggctgggctaaactgagctgggctgagctgggctggggtaaactgggctgggctgggctgaacaggctgagctgagcagtctctgaggcctctgggagaagtgcaaagtctgtgtctggggctaagctggttcccaggtgtggggttccaggcatgaaaaccattgaagacctgagccctagtgcagtagggggcgcctgtgctcctagggcggagcctgtgcctctgggcgctgtcggtcacccctgtcctgcaggactcagagacgtcctgggcaggaggcggccgtgtggtcagagctccaggaacaagcgctccttggcattggagccctggtggccaggagggctggcgactgctgctcatgggggaggggtgtgagtgtgagacgtggggctggggcgagggtctgggaccctggcaagggcagtgcaagctgggcacagagctgggccccatccctgcctcccctcggccttcaccaggcccagcctgcttcactgctccagccagcctgtcccctcctcccttcagcaccccaccctgtgcacactgcccaggggccctgaggccggggagcctgcggccctcgacggctccgtgccagccaggcttgagcagctcagccccgaggagcctggagacacagggcagcagagccagctggacacttccggccccagtcctggtccagctgctgtgtgaccctgggctggtctcctcccctctctgggccaggttccggctgtgacgatgcaggcagggtcctgtgctcccagggctctctgaggttgcagccacatgacttctatggtctcacagttgttctgtgttgcagatcctgcggaaaccccaggcatctacccgctaggcttcccctgtcctgtgtcagatgggaattcacagtatgtggtcgtcggctgcctgatccggggcttcttccccccgggccctctgagtgtgagctggaccgtcaacggggagaatgtgagcgcctataacttcccgcctgcccagt

SEQ ID NO: 96 - DNA, 24770 bp, Oryctolagus cuniculus
  misc_feature (4661)...(4670): N=A, T, G, C
  misc_feature (11224)...(11233): N=A, T, G, C
gcccctggcctgccctgaataaactccgtgctcgcccccagcagccctgcgggttcattgtgccagtctgtctcctcgggggctgcagccacagggcagggagggggagtgcccctggacctaggagctggggtctcgggcacctataggggacatcatgcatggtgcccgtgagtgtgcatgtgagtgtgagtgtgagcaaatgtgcctgtgggagtgagtgtgtctgggagtgagtgtgtctaggagtgagtgtgcctgggagtgggtgtgtctgggagtgggtgtgtctgggagcgggtatctgggagtgggtatctgggagtcagtgtgtctgggagtgagtgtgtctaggagtgagtgtgtctgggagtgagtgtgtagggagtgagcgtgtctgggagtcagtgtgtctgggagtgggtgtgtctgggagtgggtgtgtctgggagtgagtgtgtagggagtgagtgtgtctgggagtgagtgtgtctgggagggagcagtgagaggggaggctgagccggggtggattctgaggcagtgcaggcacagctcaggtcgcacccagagccgtggacaccagcaggagttcctgggcggcaggggtgcagccattgccctggtgcagaggacgagggagggagggggaggaacagggggtgtgcagggacccctgggaagaaggtgtccacaggccccacagcccagcagtgcaggacagcgctgacacacacagggcacacagcaggccccaccccgcaccacgctctctggggcctgcacacggcacacgtgctcacagggcacacacgctcacacacgtccccctcagctgcaggagagctcacagcccagacacagctccaggaaggcaggggcgtccccgcccgagccccagacggtttccccaagcccagccctgctgcccaggcccctgctgctcctctctgggcctccctgaatgtccagccatgcacagttcaaggatcatttgcacagcccaccctagacaggccctgctcactgctgggcccccagactcaaccctctaatcccctcctgagcccgagtctgagccaaaccacaggcagagaggggcaggacagagaccacccactcaggcccctcctcaggccttgggcttctgtttgcaccccagaagctctcaggccaatgtaggaatcccgggcaccaggactccaacagggcaccaggccccagctcttgcctaagccaatgattctcaggaactgagccaaaagagcagcctcctaaggaaagagagaaagggggagaattatcatggagagcagacagataagcctatgaccctaagacagtggaccatggatggacagatggacaggtggagggatggatcagtggataaatgcacaggtagatagatggctgggttaatgttagctgggtggatttttggatatgtagttagagagatggatggatgacagctttattgttgagtgaaatggtggataaatagataacagattgattgatatgatcagatattcagttataagacaaactggtcaactccaatttaacacagagatccgtgacccaggacctaggacgtctggtccactctgctggctgctggctgctggccttcgctggccgtccctcagccacttccctggggaagaacagaggctctgctcacaccatggtccctgctcatgccctgggcacactgaccccacactcagaccctgaggtgtgcctggtcctctctggacccaggtcccggccaaggccagcccaagagcagggcttaggcaggagccactgagtacgtggctcagctcaggacagcagggctccggccacaccttccctggaccagcaaggacactgccccgcctcctgtcctgcagctgcgctaagacacttgcaggggccaaccccctatgggccctgctctcaccctcagaccccatagagaccccaccactccacccccaggccccgaggaggcgtgggagagaaggccttgggccaggccccacccacacgtcaggtcctggcaggccttctgtgtcttgcaggttgtcaggagcccctgccctgtgtggtgctggatctgccacaggacagcctggaggaggaggcccccggcgccaacctgtggcccaccaccgtcaccctcctcactctcttcctgctgagcctgttctacagcacagctctgaccgtgaccagcatccggggcccgccttgcagcaaagagggaccccagtactgaggcacaggtgtggggatgccctggggagggggtccgggcccaagcagaggtgactgctgctgccatagaggggcacaggggtccctgcaggaactgggacatgggtgccctggggtcagggtgggagcgtccccggggggatgctgaggattccaccaaggctcccgggagccaggcccgggctgggacaggggagagcggtgaggacaccgcccaccctcagctgcccctgtctctgcaggagggaagcgtgcaggagcccctgggaaagccagctctgcatgccagagcccagccctccatgaagcagtgaccccccatccccctgtcaggtgcactcaacccttcccagacgaatgttctcgctctgctggacgatggctcagggaagccacgtgacttcagactgggagacgcctgccactccaacacagggacttcagcatggactggacgcggtgccccagacacggcctggccctcaggagtctcaagtccaagaccagtgcttcacctgggagggctcagaaggacgcctccctggagtggccattgaactggtctgagcactgggccctggtcctgatctctttgacctggtccttatctctgagccctggtcctattatctgatccctggtcttgatgaatgaatttttctggatagtgggccctggtcattaccactgagccctggtcctgtgcactgggccctggtcttcctcactgagccctggtcctgcacactgagccctggtcttcctcactgagccctggtccttaccactgagctctcttcctcttaactgagcagattcgtgtcactgagcaatggttctgatgactgaaccctggtcttgagcactcgccttggttctcattactaagccctgttccagatattggaccctggtcctgctcactgagccctggtcctgagcactgagccctggtcctgagtactgagccctggtcctggtcactgggcccagattctgctcactgggccctggtccttatctctgagcccaggtcgtattatctgatccctggtcttgatgactgaatgtggtctggatattgggccctggacatgacaactgagccctggtcctgctctctgagccctggtcctgagccctggtcctgctctctgggccctggtcctgagtctggtcctgatcctgggcctcgccccatcgcacacaccaggactcctcctgagctgcatcctctaaggctctgactttgcacacatcctgagccctgagtgctgaccgctctaggacgtgacctgcaggaaggccgcagccctcagggaggccccagcaggcaccgcttgcaggtgcagtcacggccgcactcctcatcctcactccgtcctctcaggccctgaggggttgcaggggtggagaggggacaagcccaggccccgggctgcctgaggtggactcagtgcctgcggtccccgggtcaggggtgcagcgcaggtgggaccgaggaggacggacggtcgtgttgttttcccctgtgttgctccttcttcagaagcttcctgtgcccgtgcacctgctgaaacccctgaaatagccctgggccggctgagtcatcccaggcacagcccaggtgtccccgctgagacccctgtcctcaggccctccacggaggcctggccagattgccccgaggcctgggcaaggacggacagcaccatggggaccatggggccctcgcacccctcaggccagggtttcacggacggcacccaccagccccagccaggcttcaggaaggccaagagctcaggttagccgggaccagcctggcttccggcagggtcagaccaggccccgctggcttccaccaggtcaggccatctcagccaggccgtctccctggggcactgacccacagcacagcagacccacggggacccgggctagcacctgccaccgcacctcagcgtccccctgcccgtgtcagagctgatgaagggcacagttccagactccacccccaggctggctccaggacaggcacaacccagggctccaggaaagacctgcatcccacacttgggacttgaactctggaaacgggtgactgagccaaggtccctcagaaagggtgactaagccagggtcggggagaggaagcaggtggagacagaaaggaaaagagacagagacaggaagggagagagatggacaagaataactgacaggatgggacccactgtgaggacgacacgaatgcagacagccgactacagggtgaacgcaccaggcacgtgtccagcacgtgagaccacagtgaagaagcccccatcccacacctcgtctctgggtgtacttccggctccatcccaacgcagctcccgctggtcagnnnnnnnnnntgtgtgtgtctgtgtccctgtgtgtgtgtgtctctgtgtgtgtccctgtgtgtgtccctgtgtgtgtctgtgtccctgtgtgtgtccctgtgtgtgtctgtgtccctgtgtgtgtctgtgtccctgtgtgtgtctgtgtccctgtgtgtgtgtctctgtgtgtgtctatgtccctgtgtgtgtgtctctgtgtgtgtgtgtctctgtgtgtgtctgtgtccctgtgtgtgtctgtgcctggcctgtgcaggtgtttgctcagctccctgcatggacagagtctgcagactcaggtccccagctccacggggcctaggactactacggggccaaggccactcagggtagggctgaggcctgggccacccagaggttgcaggggaaagggctggagaggaggccccagcctgtgacagcgtgagacaccccgggaagaccaggctgggagacccaccgagagacaggggctctcagattcaggggcaaacagagccggctggggttcccacaccactcacacaacacagcctcacactcatacaacctcaccctgcaacacacacactcacacttggaccctcccccacacctgctcactcacagcagccacacaaatccacactcactcatgacacacaggtacacacgcacacaacacttacacactcatactcacacactcacactcatacacacactcaatcccaacacacaaagactaggtctccacaacacacactcacccctacactcactcgcaacattcacacacactcaaaaattcatacccccctcagctcacacacacaatcagacccccactcactctcaacacacactcagacccccactcactcctagccctcacaggcacactcacagctgtattaactcccacacactcacacccactctctcactctcaacagtcactcacacccacactcatacacacactctcaacactcgcacactcatcacttttaccaacatttcacacaaacaccctctctcaccatccctcactcacagtcactcacgtgctcacactcatgcacccccacgcacacgcatgcccacctcactctgacatacccactcacatactttcccttgcacgctcacactctcactcccacacttacacgcacgtgctcacacccacggcctccctcccttggactcagagtcaccctgaggctcagggctgagtaacaggtcccactgctcctgctgtggcccccacgtcctgtctggggatcccatctgtgagcagggcacatgtgccctgagggcagcacccacccagggcctggctcagggtgggctgtgagctctgacggcacaggacaaaggggcaggtgggctggcagccagtgccgccaagccagcgctggttggaccctggggggttggtctgcggctgggggcagagcagcacagggagccacccccacctgccaggcaggcccccggggtggctggacacccgttggctcccactctgtcccaaccactgggtggccaggcaggcagctggggacccacatggggccccaaacacggggcagggcaggtggggacgggagagcaggagggcctgggaccctggggtgctggatgccagcccgggggctcaggcctgaggctgacgtgggcccctcaggaggggctgggcagcccggacagtcacagagggcacacacaggggacgtggtctgaggaggggagggaggctgcaggccacaggaccagtgtcctggagggacctggggggccgcgatctgtgggaaggggctcgagtgaggctcctcccaccccagtgcagcggcagcagagaggagggaagacgggtgggacaggagggcgcaggctgctggacccgcgggggctcgaggtgggggcctcggctttgcctcaactgagccgaggagcaggggctgccgtccggagaaggcacggggcggcaggaggtggagagcgttttgggtggggcccagggtcctgggcagagtggaggcgggagagcgttggccctttgaggacagagacctggagcctggccatctcctgcctgtcctcgggcagctccccccactggccgctcacgccccgaggccctctgacctgcaccagacggggcgtggggagggggcccaagacccgggcccacaccctgggcagcgtgccgtgggggccaggggtccatcctgaagggtgacgcggggacaagacaggatggaggcgcccaggggcccggggcccacccacagctcagcctacacccagctcccccgctctcccagacaccacgggggcccccgtgaccctcggcgtgccacccgccaaggttggcaagtctctgtccctctcagtcaggcctcccgggtcacccagtcccccagaactccccatcctcagtggggacgacgcagcctcgcccaaatcacactgacactcgggccccaccctggtcccgcaggctgagccgctgcccctctctggagcccccgagggcactgcccaccaggctcccggccgtgcccacgggcagtggtggggctttgccggggcccagcccctggtggggcctggctgaaggctctggtgccctgccttatctctcaaggggctgcaaggtgggggtctcctgtctccttcatgccccttcacgtgttggctgggaaccttctagaaggaggtgattgtcgggacctcacaggagcgggtgaggctgatggtggattctccttacccacaagttcaggacagggagggacccaggtgcagagagagagagagagagagggacagagagggacagggacagagtgggtctgtgacagggacggggtggagggagctcaagagaggcaagatggagtgtgtgacgctgccgcgggggcggtgagatgtgggggctcaggcagggagctcatccagagagggggagagatggcccagacagggatgggggtgacgggtggtgcgtgggggccccgctgacatcaggcagctgcccggccctgctgagcctgtgtgctcgtcagggacatgtgagtagggagtggggcgtggggccctgggtcacccggggcgtccagccccacccctggggtccccgttggtgctggccgagggccctgtggttgagcctgtggcccctgggctgctcagggagccctgatcgcgaagggacacttggggccgagaccccctgagcttgctgaggccggcattcaccacgccgcgggcacaggcctggcctggcctggccatgggggtgcagccgggcggggccgcaggtggagaccggcagctatttctggaaacagcctcggtgggcgagaagcacgctttctggagtggaaccgcatttgcatgcgcctgtgagggccgagtgtgcccggaatgagtcacctggggaggatctcacacctgcggggggggggggggtgctgacacgcagcccccagcccccggggcagcagctgccatcagcagcaccatcttggaagacccccagggcgctgggcaggccccccagggcagacaagaacacgttgccaggaggggtctcagccagtgtggacgggacccccccccgggacccgggtcacaggggaggcagcagctgttggtccttggggctcagggctccagggtttggggtcctggggtgcactcagcactggtcctgccagggagtctgcagccctgaacgtgggcagatgtggccaaccttggcgggggctgggaaggcagggacagcaggccctggggaggcactcgagggggtagtgtgtgcctggtggtccaggcaggaggaccgcggagtctgagggagcccaggtggggatcccaacccggggctggggacaagcaattcgtgttccagaaagatccctcaaacatggggggagggggcttcttactctgaaaactggaaagtgaacaggcacaggcagcctcactccgcctctgtccccctctccccccttctctctctgtccccccccctccctctctctctgtccccccctctctccctctctctctgtcccccctctctgtgtccccctctccctgtccctctctctctgtcactctctctcaatctctctctgtccccctccgtgtccatctctatctctctatccctctctctttctctttgtcttccccctctgcctctctctttctccatctctttgtctctgtctctctctgtccctccctccctctctcctctctccctctccccgtgtgtgtgtgtgtgtgtgtgcgcacgtgtgtgtgtgtgtctgtccctctctctctctctctctctgcacctgggtccctccctgtcctgaacttgtgggtaaggagacgccaccatcagcctcacccgctcctgtgaggtcccgacaatcacctccttctagaaggttcccagccaacacgtgaaggggcgtgaaggagacaggagacccccaccttgcagccccttgagagataagacagggcaccagagccttcagccaggccccaccaggggctgggccccggcaaagccccaccactgcccatgggcacggccgggagcctggtgggcagtgccctcgggggctccagagaggggcagcggctcagcctgcggggccagggtggggcccgagtgtcagtgtgatttgggcgaggctgcgtcgtccccactgaggatggggagttctgggggactgggtgacccgggaggcctgactgagagggacagagacttgccaaccttggcgggtggcacgccgagggtcacgggggcccccgtggtgtctgggagagcgggggagctgggtgtaggctgagctgtgggtgggccccgtggcccctgggcgcctccatcctgtcttgtccccgcgtcacccttcaggatggacccctggcccccacggcacgctgcccagggtgtgggcccgggtcttgggccccctccccacgccccgtctggtgcaggtcagagggcctcggggcgtgagcggccagtggggggagctgcccgaggacaggcaggagatggccaggctccaggtctctgtcctcaaagggccaacgctctcccgcctccactctgcccaggaccctgggccccacccaaaacgctctccacctcctgccgccccgtgccttctccggacggcagcccctgctcctcggctcagttgaggcaaagccgaggcccccacctcgagcccccgcgggtccagcagcctgcgccctcctgtcccacccgtcttccctcctctctgctgccgctgcactggggtgggaggagcctcactcgagccccttcccacagatcgcggccccccaggtccctccaggacactggtcctgtggcctgcagcctccctcccctcctcagaccacgtcccctgtgtgtgccctctgtgactgtccgggctgcccagcccctcctgaggggcccacgtcagcctcaggcctgagcccccgggctggcatccagcaccccagggtcccaggccctcctgctctcccgtccccacctgccctgccccgtgtttggggccccatgtgggtccccagctgcctgcctggccacccagtggttgggacagagtgggagccaacgggtgtccagccaccccgggggcctgcctggcaggtgggggtggctccctgtgctgctctgcccccagccgcagaccaaccccccagggtccaaccagcgctggcttggcggcactggctgccagcccacctgcccctttgtcctgtgccgtcagagctcacagcccaccctgagccaggccctgggtgggtgctgccctcagggcacatgtgccctgctcacagatgggatccccagacaggacgtgggggccacagcaggagcagtgggacctgttactcagccctgagcctcagggtgactctgagtccaagggagggaggccgtgggtgtgagcacgtgcgtgtaagtgtgggagtgagagtgtgagcgtgcaagggaaagtatgtgagtgggtatgtcagagtgaggtgggcatgcgtgtgcgtgggggtgcatgagtgtgagcacgtgagtgactgtgagtgagggatggtgagagagggtgtttgtgtgaaatgttggtaaaagtgatgagtgtgcgagtgttgagagtgtgtgtatgagtgtgggtgtgagtgactgttgagagtgagagagtgggtgtgagtgtgtgggagttaatacagctgtgagtgtgcctgtgagggctaggagtgagtgggggtctgagtgtgtgttgagagtgagtgtgagtgtgtgattgttgagaatgagcggtggtgtgtgagtgtgtgcatacgagtgtgcaaagcatgggtgtgcgatgtgcttcatgaggcttctgctcttgtcactgccagttttttcccctgtattgatggctcttgactcttttactcttaaaaataacgtggtttatttatttatttatttatttatttatttatttatttattatttgagaggcagaaagtgagtagagagtcgagagagcagaggaaannnnnnnnnnggacacactcagacacacacagacaaacacacagggacacactcagacacacacagggacacagagagacacatatagggacacacacagacacacacacagacacacacagggacacaaacatagggacatgcacacagacacacacatagacacagagagacacacagggacacagagagacacacagggacacactcagagacacacacagagacacacacacagggacacatgcacagagacacacagagacacacagggacacacacagacaacagggacacactcagacacacacagggacacacagacacacacagggacacagggacacactcagacacacacagaaagacacacacagggacacacacagaaagacacacagagggacacacacagagggacacacagggacacacacacagagacacacagagggagacacacacagacacatgcagatacacaccacctacacaaccaagtcacacacacatatgaatacacacatatatgggcacacacagagacatacccacatgctcagacacacacagagacacagagattcacacacacacatatatggacacacacagacacacacacatatggatacacacagatactcagacacacagatacacatacacatggaaacacacagacacacacctacaatctcagacacacagagacagagacacacacagacaccgacaggctcagacacacacaatcacacacatacacagaaacaaaaagaaaaacactcacagattcgcacacactcagacacacacaagtgaagatacactcacactcacacacatgcagatacagacacacccagatacacctcaacacactctgatacacagatacactcacacacactcggataaacacacagacacacacatatgtgttcacacactcagacactcaggccccacagccccagcagtgccctcccaactgccctgcccttcagccctggccctgcgccttccaagtagccagggggcctgggcagagtggacagagacaagtctggggctggggacggtgaagtcaggcctggaaggatgagaggggtttgcccgcccacccgggagcccccgcacacctgcacacacaccacacgcagcttccacttgtggctcacgctcatgctcacacgcacactcctgcacacgcgcgcgtggtgtggctgggccgggctttggcgtgtggggtcagggagagctggcagagggagtgcctcggccattctgggccagtcgggctgcaggcgggggtccaggcacagggcagcggcacctcagtaccatgagggcagctcagactggcatcgtgtggggtcaccatagcattgcacacgtgtgttcctggcatgtcgcatgtgcgcatgtgagggactcctagggtggtctccccagggcgttggcacacgacgcctgggcccctagctcagggacacagtggggccggaagcttctgtctactgaccagccctgggccggctctgttgtgaacactaggcagagccaggccgcactcagaattggcatctggaccacccgggggcccctcaaaacagctccacacctgaccagggtgggctgtacacccggggggcccagccgggaccctcatgccggatgcctggagcagagccccggctcccctcccccaccacagcccagtctgaaaaacaagacccggtgtgggcacccagctgtggctcccacccacgctgtgcaccgggacaaacaagcacttgcaaatgtttctaaaatcgggaagtgcgggaaccacagagcaggtggggcccggggtggaaagccccactcacccctgagaccgaaactggagaagccaggactgtgggggatttgcattgggggagggggcaagccaggctgcttgggaggactgctaaccctcccagcccccaccctgccacctcagctagccaggcctgtgctgtggcgtggccaggcccagagtgaccagagccaccagaccccaggagcgcttcccagagaagaaacctcgtgtaagggcacggggggcttccctgcccaggcagaacgcggggccagccggccgcccctgggggaaggggctcacattcaggcccttgacaacctgctctgtgtccaagctttgtccctgctgtgcccacactggaccatcccagccagcttcaaggcacggcccctcgggcacgtccacccccagcctcaggattccctgggcctcgcaacagctgcccccgaccagacctgcctgagcccagccccgtgcgccgggggacacagaggcctgtgcgacccaccccactccggccctcggcgcaccagccgggtccctagcgctctggggcagaggcaggaagggtctgtgcgggcatccctccccgccgagccgagcctgcagggagccctgggggccggaggaaaaggggctcaaagctcagccactgtggccgagagagcggtcaggcagcatccagccggcacgggtcccccagaacagtcacactgaccacacgcacagacacaccagagatgcccagagagacaggcagacgcactcagagatacactgaccacacgcgcagactcacacagggccagggccacacacggagacacacgcagacacacacagagccacacagagagacacatacacatgcagagacacacaaccacacacacacacagagatacacagacacacacaggaacagacagggccacacacagagacacatacacacacagagacaaacacagacacatacagagccacacagagagacacacacacacagacacaaaggaacagagccacacacggagacacacgcagacacacacagaaccacacagacacacgcagacacacacaggaacagacagaaccacacacagacacgcaaacacacacactcacatgcagaggcacacacagacacatgcagacacacacagagacaaacacacacacactcacatgcagaggcacacacagacacatgcagacacacacagagacaaacacacacacactcacatgcagaggcacacacagacacatgcagacacacacagagacaaacacacacactcacatgcagaggcacacacagacacatgcagacacacacagagacaaacacacacactcacatgcagaggcacacacagacacatgcagacacacacagagacaaacacacacacactcatatgcagaggcacacacagacacatgcagacacacacagagacaaacacacacacactcacatgcagaggcacacacagacacatgcagacacacagagacaaacacacacacatacacacatgcagaggcacacacagacacatgcagacacacagagagacacacacacacacactcacatgcagaggcacacacagacacatgcagacacacacacagagacaaacacacacacatacacacatgcagaggcacacacagacacatgcagacacacaaacacacacacactcacatgcagaggcacacacagacacatgcagacacacacacagacacccagacacagacactcagagactcacacaggaacagacacggccacatgctcaatgcagccgtactcgatcagggctcccaggcacacgccaaccccggacacacacaggaaggtggggtgggctgggagggactccgagaccccaggcctcttctcaggctcccctgggtgtggcttcattctggcgacaggggtaccccaggtctgcagtccacagcgggaggctcacctcacaccggcacacccagcactgcccaggctccacaccacagggagggcacactcacactcacacacccacccacacactcgcatgcccactcacactcacattcacacacactcacatacccactcacacacacactcgcatgcccgctcacactcacactcacactcacatacccactcacactcacacacacccactcacacacacacacacacatgcccactcacacacacactcacatgcccactcacactcacattcacacacacactcacatacccactcacacacacacacactcacatacccactcacacacacactcacatacccactcacacacacacacacactcacatacccactcacactcacgcacacacatacccactcacactcacgcacacacatacccactcacactcacacacactcacatacccactcacacacacacactcgcatgcccgctcacactcacattcaaatgcccactcacactcacatgcccactcacatgtgcactcatacacccactcacactcatattcacacacacactcacacactcacactcacacacccactcacactcacacactcatatgcccattcacactcacgtgcccactcacactcacactcacgtgcccactcatactcgcatgcccactcacactcacactcgcattcacacacctactcacacatccactcacacttgcattcaaatgcccactcacactcacatttaaatgcacactcacacacccacttgcactcacatgtccactcacacacactcacacacctactcacatgcccactcacacactcatactcgcacatccacttacatgcccactcacacacacattcacacactcacatacacacactcacactcacacacacacattcacacactcacactcacacatactcacactcacatacacactcacactcacatacacactcacacactcacactcacccattcacactcacactcacatactcacacgcccactgtcagccacacacacagcttcggcagctgctggtgagtccaacgcctgagctcctccaccctgggccgagcacgtggacccggtgccgcctcgccatgagcatggctgggagccctgccctcccacccccatcctgcacctccgtgtccccacactgccccctcccactcccacctgcccctctgggggtcactccagaccccacacctggccacagcccacagtgcaccgggagactgctgcgtggccacctgtgcccagggcctcctgcggggagcacgggcaggcgggtctgctgtgtggtccagggtccagggaggacagcaggcacaaggtgaccactgccgctctcatcctctgccgagcacctcgcctggaaacccagtcacagccaggcctgtgtctcgaccccagcactccccccaggcccgctgccagccgagggcagagcaggtgcgggcagtggctgagcccccacatgcagccccgtgggttaggtgaccccatgaagcctgaagccccttgggggaagaggtcaatgtggggccgccagttcttgaggctgggccagccatggaggccggcacctgaaacgtccctccaggctgcggcagtaggtggtgtcacagtgaaaagcagccggccctgtctctgggagggaaaggaaagtccattctgtgagggcagccccgtgtcctgtcgggcgcggcatgaggacggggtgtgaaacgcttgatgagcttatgacccaagagaaagagcgagccagggtcctgggggggaagggggggaccaggaatcccagtgaggcagccctgggggtcaggggaggtgaggcagccctggaggtcaggggaggtgaggcctcacatgcagacacacacagagacacccagccctggggggagatggggggaggtgagatagccctgggggtgagatgggggaggtgagatagccctggggtgagatgggggaggtgagatagccctgggggtcagggaggtgaggcagccctggaggtcaggggaggtgaggcagccctggggggagatggggggaggtgagatagccctggggggtgagatggggggaggtgagatagcccttgggggtgaggtgagatgggggaggtgaggcagccctgggggggtgagatagccctggggggtgagatgggggaggtgagatagcccttgggggtgaggtgagatggggggaggtgagatagccctggggggtgaggtgagatgggggaggtgagatagccctggagggtgagatgggggaggtgagatagccctggggggggggggatgggggaggtgagatagccctggggggtgaggtgagatgggggaggtgagatagccctggggggtgaggtgagatgggggaggtgagatagccctggagggtgagatgggggaggtgagatagccctggggggggatgggggaggtgaggcagccctgggggcacaagtgctgtccccacatccatcagagggtggcagggagggactgctacaggggggcagtcctggggagcagctcttcctggggtctcccctggccctcagacctgctctgcccccagccccacagtccatgaaactccccggcccaccccacagaaggccacttaggacagtcacactgtgtgttctcctgtgttacagacgttaacctcgaattccacgactgtaaactgttgagaccactcaggaggccctgggcagcagttaggcccgcaccccaaatcgagcgcgggggaccaagtcctgcctgcgctcccagccagctgggctgccggcggggcggggggcatgtcccagcccccatggagtcctgtgaaccggcagatggaggctctgtggctctgcctttcaaataaataaataaaactgaaaaactaacaaaacaaaaagccgtgcaccagaagccgcagcaggcactagggcaggggtctcatcagagatgggggcggggcggggggcgtgagggcttggccagggcgcgctctgtgacctccgctctccgcggggatcaaacgtttccttgtaagatgcaaactctgcaggctggggtctcccttcccgcatgcgccagctccgaaccccaccacgggtctccccgggcagcggacaagaccccccagcccaccccggcggccggcactcggtgcccctgccccaggagccaggagccggcgcgggccgggccgtgcgggatgggactggcggcctcgtgggaactcggtgctttagatgggtttaacaggggtgcggggagtggaggcccacgcggccgagccccgccaagtcccacccttagggtccgacggcgtcggcggcagagtctctccgctccgcggccctgggaaaccccgggcaggggaccctgggcggccaagcggatcctggggacagggcctggggagggtgggctgggggctcttgggggcgccacgtgcccgggagctggaacagggacacggctcgcgggcttccgcacacctcttcgaggcccgcggtgccccctccccgcgtgcagggcctaacgaggcagaggtgcgctctcagcacgcgggatgctgggcccagggccagcacggcgggggctgtgcggggagaggcggccgcgcagggtcctcgccgcccgctgagccgcagccccgagcccggcagggctctgctgcccccgtgtggccgccggcagccgctccacagcccggggctggactgcggcccaggcgcggcggaaggaggggacggagggcagggcggagggcggaggggacagggcgggcaacagggcgggggcagagccgggcagggtccgggaccaggtggcagttggcggctccctcgaggctcgggcgccccctcgtggcctctctcgtcccctgcactccgtgtccactgttagcgggcggcaggtcccggcccccacccagtttcccggccagcagggagtcccggggctctacatgagggccgtttggccacagcaggacagaggggcttccaacggcaagggtgagaggcgtcggcagaactggggggcgcccctttgtcccccacctgcctgcacccctgccccagcagctccttgtgggaggcgcagttcctcggaacgagggcaggggttccccgctagtgagactgtgggtacagacggggcaaggtcaggctcgggaggggcccggatccctggcaggtgccacctgcgcggctggcgcgggacgcgcgcgggtgaggccgcttgggcgccccctggtggccgcgctgcaccactgcgcgccccggatcggcctcgaggacgcgggggctccgttcggctcgcgccgggcgcctcctttaacgcaacgagccacttccgagggtgcgtggggctcgaggaaggccgttccccaagggacgccgccgaggaggggcctcggccgcctgcacgcgtgctctaagccggaggtccgcgccactagccagagcgcgctgggttcccgctggggtctgcgcctgaagcaagccgcagagagccgcgtcctccccggagccccccagagcggcggtcagcccgaagatcaggccctggaggcccgcgcccggcggagcggctggcgacgcccgcgtgcgcaccctggcggccacgagcgggacaacgcagggcgccccgcgagcgccaggagcggactcggggcaggagcgccggcgcgctctgcctttcaaatgtaaaaaaataataatgatgatgatgaaagcacctgagaatgggccaaggaaagccgcggagccccccggtgccgccaggcgcggccgcagcgccgtccccctgtgcccccggctgaccggtcagttcgggctggcaggggactgggcccgcggcaggagtcccgggaaagaggggacttgcgctgcgatggcccctggggctggaggcggcctgcggggcgcgcggaggacgcaccccacgctccccgcatttggttttgcttccacgtgaatccgggctgctcagctgtgcgtgagggcccagcagcccccatggaccagccccaggaggacgccagggggtggcttcccagcgctcttggcggcgggagaggctgggacccacgcacgctgaggctcccgcaccaggcaggcagtggggcctccagaggggagcagagacgcgggtccctgggccatccgcagggcctgacagaatctgactcccgggactggcactcagtgggcacgggggatccgagcgatgacttcagatatgaagtgatgacttcatccttgatttgaaagagttaacaggggccggtgctgtggcgaagcgtgtaaagccaccacctgcagtgctggcatcccatatgggcaccggttcaagacccggctgctccacttccgatccagctccctgcgatggcctgggaaagtagtagaagatggcccaagtccttgggcccctgcacccacgtgggagacccagaagctcctggctcctggcttcagatcggccgagctcgggctgctgtggccgtttggggagtgaaccagcggatgggagacctctctctctgcctctttgtagctctgccattcaaataaataaataaaatcttaaattaaaaaaaaaaaaaaagaggagcagccaggactcggaccggcaaccatatgggatgctggccctgcaggcaggggtgtaggcttctaccccacagcgccggccccaggcaattttgtgagcattgaaatagttgatgcacgggtaggctagtggcgcagcaggttaagcccagcctgcgatgccagcatcccacacaagcaccgactcaagggagggagacccagatggagctcctggctccaggcttcagcctgcccagccccagctgttgcagccacctggggagccaaccagcggatggaagattctctctctctgtctcctctctcctctcccagtcaagctgccttttggataagtaaataaataaatcttataaaagtcgagctggcaccaggaagagaggaagaggcggctccgtcggagtccagcggggcttggcgtcttgaattctgcaccgtgagaaagtgcggctttggcggcaggagctcccgatcgccctcagaccctgcgtctcagcgagcgggtctcaaagaccctgggtgcatcccgcacgttctacggcaaagtcagctcaggatgtaacgcccaaatctgacctgtgaaacgggtgcccttaatccagcctggggtgtgccggccaagagcgcagcgggaggcggggtgggggggttggtggggggaggggggcagaggggaggcagagggtgttggtggggggaggcgggagggggcaagaagaggcggggggggggtgcgggaggcggcagcgccggcccaggcgcccagggcagtgagctctgcagccgtctgtgccacgcgtgcgtgtggatgtgtgtgcatcgcatgcgttgctgcacatgtgtgtgcgtgtggtgtgcgtgtgcactgtgcactctgttgcgtcgtattgcatggtgcgtgtgtgcacatcacatgtgtgttgtgtgtgctgtgcgcgtgtgatccaccacgtgtacctctgtgcacgggggcgggggcagcgctagtgcccaggtcctctacttccgggggcgggagcatccccgccgcccctgcccccgggtctcctagagccgcgcgctgtgctttagttacggggtggtctcggggctgcgaggatctcctaacggctggccagggcggccgcattgcgtcactcgggttctgacgtcacgctgctttgcattcgagggattttgtgttttccctgctttccacggaataggtgatccttcttcctgccggagtgaaagctgtgcgtgttgccattgttctgagacgcgtttttaatcgcgggctcttagcaccgaatgcatcacaagccgcccgcgcagcctcggcgtctcccgcaccccgcggtgcggcctcctcccggctctgcccctttgtgtggagctcgggcaccctctggtggccacgccgcgacactgctcctgcgccggccaggtgagccttgcgggcggtcctcacattcccgccaccgccctgccagcggccctgcgtcccctctggggccacccttgctctcctctgcgcagctcgcggccccactcacctgtgtgaccccgtctcgccgcagaagaggagcacctcctcctaggaggcgtcccggggccaccctcgggcacgtgccctcacgggactgctgggcgcacctgtacgggcacctggatgcccggctcagccgcagcctccgtcagggccacgacgggacgagacaagcgccggaagccgcgcgattctccccagacggcaccggcaccaggcaggcgccagcaccaggcaggcgggagaaaggtgcaaccacactcagcgatgagcaaaccccttccacgcgtgcatgacgtgtacacgtgctgcaggtgctgctggccgccgggacacctgccggagccccagctcagccacccccagtgccccggctcggctgcccctacacaggcagggcggcgctgggtccccggcacgaagggtgaggctgacggacggcaggtgagcctcacctgatggtttctcccacaactgcatccgcacaagggcactgccatgagggcagcagagaccaagggcaccgcgggagccagagggaccggaggacgcccccggcgggtggggaccccggcccggccctccccccactcagcctctgaacacgccctgtccccgtgcagtgtctgctctcccagtcaagccctcggatcttctgagactccggctgccggcggggggatgggggggacacactgaccacgaagccaggggccttaccctggctctggtaggagcgggcactgatgcagcagtcaagacgcccacacacgtcccacattgggggtcgggccctggctgtgtgtcgagctctcaatttgcactaactcagaccctgggagccgaccggctgggtccctgccacccacgtgggagcccctaattgagttctgggctcctggggcccctggaagtgagccagagaacgtctctggctctgcctttcttcactgcgtgaggtgcagtcagcccctttgctcacaggcggtgatgctgtggacagaaagatcggaccacaggctggagcaccggagccaagctctgggccgagggtgaggctgcagaaccaacgcagccagggccaggaccacgggacagcagacagcgcagggaagtgtgaggtccacgtggagatgtggagactagggcagaagccagaatccagtgacccccagtgatgcccagtgacacccagtgatgccccagagacacccaggaacaccccagtgatgcccagtgatacccctatgatgccccagagacaccccagtgacacccagtggtgcccagtgacgcccagtgatgcccagcaatgccccagtgacccccagtgatgcccagcgatacccagtgacacccagtgacccccagtgatgccctgtgatgcccagtggtgcccagtgacccccagtggtgcccaccaacacccagtgacgcccagtagtgcccagtgatgtccagtggtgcccagcgacacccggtgacacccagtggtgcccagtgacacccagtggtgcccagttgatgcccagtgacccccagtgactgcctttggcccaagcatgtggcccgtgtgcatcctcactcagccccaggtgacgctcaagtgctgtggtcccgccctccacatggaggcgcaggtggagctcctggcccagccccggccgtcgtgggcatttgtggagtgaaccagtggctgggggctcactccctctccctcttaaaaaaatttaaaagcaaattaagtaactagatatgtaaacaataaaacaataatgtcctgggcctgggtgtggcgtagcaggtaaagccaccacctgcagtgctggcatcccatatgggcaccggttcaagtcccggctgctccatttcagatccagctccctgctatggcctgggcaagcagtagaagacggcccaagtccttgggcccctgcacatgtgtgggagacctagaagaagttcctgggtcctggcttcagatcagcatagctccagctgttgtggccaattggagagtgaaccagtggatagaagattctctctctctctctctctctgcctctgcctctcaaataaataatctttttttttttttgacagtcagagtggacagagagagagagagagacagagaaaaaggtcttcctttgctgttggttcaccctccagtggcctccgcggccggcgcgctgcagccggtgcaccacgctgatccgatggcaggagccaggtgcttctcctggtctcccatgtgggtgcagggcccaagcacttgggccatcctccactgcactccctggccacagcagagagctgacctggaagaggggcaaccgggacagaatccagcgccccgaccgggactagaacccggtgtgccggcgccgcaaggcggaggattagcctagtgagccgcggcgccggcctcaaataaataatctttaaaaatagtgatccaagcttctccctatagtgagtcgtatta

SEQ ID NO: 97 - DNA, 138 bp, Oryctolagus cuniculus
gtaagagggcaggctggggtggggcgatgaggctgcagagtgggctactgggccgaccccagggactgcagaccaagggcagcctgaggccagggatggacaaggggccactgacacataacaactctgtttcttcag

SEQ ID NO: 98 - DNA, 178 bp, Oryctolagus cuniculus
tgggcctgcccccacccccgggcaatgggctgctctcctcaccctggccttactcctccctcccctcctgggctctgaggctccctccctggaaaacagagggaaactgaggccagcgtgcatgacaatggggtttattctttgcctgctgtcctgatcctgctctcccccttccagg

SEQ ID NO: 99 - DNA, 2058 bp, Oryctolagus cuniculus
gcccctggcctgccctgaataaactccgtgctcgcccccagcagccctgcgggttcattgtgccagtctgtctcctcgggggctgcagccacagggcagggagggggagtgcccctggacctaggagctggggtctcgggcacctataggggacatcatgcatggtgcccgtgagtgtgcatgtgagtgtgagtgtgagcaaatgtgcctgtgggagtgagtgtgtctgggagtgagtgtgtctaggagtgagtgtgcctgggagtgggtgtgtctgggagtgggtgtgtctgggagcgggtatctgggagtgggtatctgggagtcagtgtgtctgggagtgagtgtgtctaggagtgagtgtgtctgggagtgagtgtgtagggagtgagcgtgtctgggagtcagtgtgtctgggagtgggtgtgtctgggagtgggtgtgtctgggagtgagtgtgtagggagtgagtgtgtctgggagtgagtgtgtctgggagggagcagtgagaggggaggctgagccggggtggattctgaggcagtgcaggcacagctcaggtcgcacccagagccgtggacaccagcaggagttcctgggcggcaggggtgcagccattgccctggtgcagaggacgagggagggagggggaggaacagggggtgtgcagggacccctgggaagaaggtgtccacaggccccacagcccagcagtgcaggacagcgctgacacacacagggcacacagcaggccccaccccgcaccacgctctctggggcctgcacacggcacacgtgctcacagggcacacacgctcacacacgtccccctcagctgcaggagagctcacagcccagacacagctccaggaaggcaggggcgtccccgcccgagccccagacggtttccccaagcccagccctgctgcccaggcccctgctgctcctctctgggcctccctgaatgtccagccatgcacagttcaaggatcatttgcacagcccaccctagacaggccctgctcactgctgggcccccagactcaaccctctaatcccctcctgagcccgagtctgagccaaaccacaggcagagaggggcaggacagagaccacccactcaggcccctcctcaggccttgggcttctgtttgcaccccagaagctctcaggccaatgtaggaatcccgggcaccaggactccaacagggcaccaggccccagctcttgcctaagccaatgattctcaggaactgagccaaaagagcagcctcctaaggaaagagagaaagggggagaattatcatggagagcagacagataagcctatgaccctaagacagtggaccatggatggacagatggacaggtggagggatggatcagtggataaatgcacaggtagatagatggctgggttaatgttagctgggtggatttttggatatgtagttagagagatggatggatgacagctttattgttgagtgaaatggtggataaatagataacagattgattgatatgatcagatattcagttataagacaaactggtcaactccaatttaacacagagatccgtgacccaggacctaggacgtctggtccactctgctggctgctggctgctggccttcgctggccgtccctcagccacttccctggggaagaacagaggctctgctcacaccatggtccctgctcatgccctgggcacactgaccccacactcagaccctgaggtgtgcctggtcctctctggacccaggtcccggccaaggccagcccaagagcagggcttaggcaggagccactgagtacgtggctcagctcaggacagcagggctccggccacaccttccctggaccagcaaggacactgccccgcctcctgtcctgcagctgcgctaagacacttgcaggggccaaccccctatgggccctgctctcaccctcagaccccatagagaccccaccactccacccccaggccccgaggaggcgtgggagagaaggccttgggccaggccccacccacacgtcaggtcctggcagg

SEQ ID NO: 100 - DNA, 16668 bp, Oryctolagus cuniculus
  misc_feature (3122)...(3131): N=A, T, G, C
tcacacctgcggggggggggggggtgctgacacgcagcccccagcccccggggcagcagctgccatcagcagcaccatcttggaagacccccagggcgctgggcaggccccccagggcagacaagaacacgttgccaggaggggtctcagccagtgtggacgggacccccccccgggacccgggtcacaggggaggcagcagctgttggtccttggggctcagggctccagggtttggggtcctggggtgcactcagcactggtcctgccagggagtctgcagccctgaacgtgggcagatgtggccaaccttggcgggggctgggaaggcagggacagcaggccctggggaggcactcgagggggtagtgtgtgcctggtggtccaggcaggaggaccgcggagtctgagggagcccaggtggggatcccaacccggggctggggacaagcaattcgtgttccagaaagatccctcaaacatggggggagggggcttcttactctgaaaactggaaagtgaacaggcacaggcagcctcactccgcctctgtccccctctccccccttctctctctgtccccccccctccctctctctctgtccccccctctctccctctctctctgtcccccctctctgtgtccccctctccctgtccctctctctctgtcactctctctcaatctctctctgtccccctccgtgtccatctctatctctctatccctctctctttctctttgtcttccccctctgcctctctctttctccatctctttgtctctgtctctctctgtccctccctccctctctcctctctccctctccccgtgtgtgtgtgtgtgtgtgtgcgcacgtgtgtgtgtgtgtctgtccctctctctctctctctctctgcacctgggtccctccctgtcctgaacttgtgggtaaggagacgccaccatcagcctcacccgctcctgtgaggtcccgacaatcacctccttctagaaggttcccagccaacacgtgaaggggcgtgaaggagacaggagacccccaccttgcagccccttgagagataagacagggcaccagagccttcagccaggccccaccaggggctgggccccggcaaagccccaccactgcccatgggcacggccgggagcctggtgggcagtgccctcgggggctccagagaggggcagcggctcagcctgcggggccagggtggggcccgagtgtcagtgtgatttgggcgaggctgcgtcgtccccactgaggatggggagttctgggggactgggtgacccgggaggcctgactgagagggacagagacttgccaaccttggcgggtggcacgccgagggtcacgggggcccccgtggtgtctgggagagcgggggagctgggtgtaggctgagctgtgggtgggccccgtggcccctgggcgcctccatcctgtcttgtccccgcgtcacccttcaggatggacccctggcccccacggcacgctgcccagggtgtgggcccgggtcttgggccccctccccacgccccgtctggtgcaggtcagagggcctcggggcgtgagcggccagtggggggagctgcccgaggacaggcaggagatggccaggctccaggtctctgtcctcaaagggccaacgctctcccgcctccactctgcccaggaccctgggccccacccaaaacgctctccacctcctgccgccccgtgccttctccggacggcagcccctgctcctcggctcagttgaggcaaagccgaggcccccacctcgagcccccgcgggtccagcagcctgcgccctcctgtcccacccgtcttccctcctctctgctgccgctgcactggggtgggaggagcctcactcgagccccttcccacagatcgcggccccccaggtccctccaggacactggtcctgtggcctgcagcctccctcccctcctcagaccacgtcccctgtgtgtgccctctgtgactgtccgggctgcccagcccctcctgaggggcccacgtcagcctcaggcctgagcccccgggctggcatccagcaccccagggtcccaggccctcctgctctcccgtccccacctgccctgccccgtgtttggggccccatgtgggtccccagctgcctgcctggccacccagtggttgggacagagtgggagccaacgggtgtccagccaccccgggggcctgcctggcaggtgggggtggctccctgtgctgctctgcccccagccgcagaccaaccccccagggtccaaccagcgctggcttggcggcactggctgccagcccacctgcccctttgtcctgtgccgtcagagctcacagcccaccctgagccaggccctgggtgggtgctgccctcagggcacatgtgccctgctcacagatgggatccccagacaggacgtgggggccacagcaggagcagtgggacctgttactcagccctgagcctcagggtgactctgagtccaagggagggaggccgtgggtgtgagcacgtgcgtgtaagtgtgggagtgagagtgtgagcgtgcaagggaaagtatgtgagtgggtatgtcagagtgaggtgggcatgcgtgtgcgtgggggtgcatgagtgtgagcacgtgagtgactgtgagtgagggatggtgagagagggtgtttgtgtgaaatgttggtaaaagtgatgagtgtgcgagtgttgagagtgtgtgtatgagtgtgggtgtgagtgactgttgagagtgagagagtgggtgtgagtgtgtgggagttaatacagctgtgagtgtgcctgtgagggctaggagtgagtgggggtctgagtgtgtgttgagagtgagtgtgagtgtgtgattgttgagaatgagcggtggtgtgtgagtgtgtgcatacgagtgtgcaaagcatgggtgtgcgatgtgcttcatgaggcttctgctcttgtcactgccagttttttcccctgtattgatggctcttgactcttttactcttaaaaataacgtggtttatttatttatttatttatttatttatttatttatttattatttgagaggcagaaagtgagtagagagtcgagagagcagaggaaannnnnnnnnnggacacactcagacacacacagacaaacacacagggacacactcagacacacacagggacacagagagacacatatagggacacacacagacacacacacagacacacacagggacacaaacatagggacatgcacacagacacacacatagacacagagagacacacagggacacagagagacacacagggacacactcagagacacacacagagacacacacacagggacacatgcacagagacacacagagacacacagggacacacacagacaacagggacacactcagacacacacagggacacacagacacacacagggacacagggacacactcagacacacacagaaagacacacacagggacacacacagaaagacacacagagggacacacacagagggacacacagggacacacacacagagacacacagagggagacacacacagacacatgcagatacacaccacctacacaaccaagtcacacacacatatgaatacacacatatatgggcacacacagagacatacccacatgctcagacacacacagagacacagagattcacacacacacatatatggacacacacagacacacacacatatggatacacacagatactcagacacacagatacacatacacatggaaacacacagacacacacctacaatctcagacacacagagacagagacacacacagacaccgacaggctcagacacacacaatcacacacatacacagaaacaaaaagaaaaacactcacagattcgcacacactcagacacacacaagtgaagatacactcacactcacacacatgcagatacagacacacccagatacacctcaacacactctgatacacagatacactcacacacactcggataaacacacagacacacacatatgtgttcacacactcagacactcaggccccacagccccagcagtgccctcccaactgccctgcccttcagccctggccctgcgccttccaagtagccagggggcctgggcagagtggacagagacaagtctggggctggggacggtgaagtcaggcctggaaggatgagaggggtttgcccgcccacccgggagcccccgcacacctgcacacacaccacacgcagcttccacttgtggctcacgctcatgctcacacgcacactcctgcacacgcgcgcgtggtgtggctgggccgggctttggcgtgtggggtcagggagagctggcagagggagtgcctcggccattctgggccagtcgggctgcaggcgggggtccaggcacagggcagcggcacctcagtaccatgagggcagctcagactggcatcgtgtggggtcaccatagcattgcacacgtgtgttcctggcatgtcgcatgtgcgcatgtgagggactcctagggtggtctccccagggcgttggcacacgacgcctgggcccctagctcagggacacagtggggccggaagcttctgtctactgaccagccctgggccggctctgttgtgaacactaggcagagccaggccgcactcagaattggcatctggaccacccgggggcccctcaaaacagctccacacctgaccagggtgggctgtacacccggggggcccagccgggaccctcatgccggatgcctggagcagagccccggctcccctcccccaccacagcccagtctgaaaaacaagacccggtgtgggcacccagctgtggctcccacccacgctgtgcaccgggacaaacaagcacttgcaaatgtttctaaaatcgggaagtgcgggaaccacagagcaggtggggcccggggtggaaagccccactcacccctgagaccgaaactggagaagccaggactgtgggggatttgcattgggggagggggcaagccaggctgcttgggaggactgctaaccctcccagcccccaccctgccacctcagctagccaggcctgtgctgtggcgtggccaggcccagagtgaccagagccaccagaccccaggagcgcttcccagagaagaaacctcgtgtaagggcacggggggcttccctgcccaggcagaacgcggggccagccggccgcccctgggggaaggggctcacattcaggcccttgacaacctgctctgtgtccaagctttgtccctgctgtgcccacactggaccatcccagccagcttcaaggcacggcccctcgggcacgtccacccccagcctcaggattccctgggcctcgcaacagctgcccccgaccagacctgcctgagcccagccccgtgcgccgggggacacagaggcctgtgcgacccaccccactccggccctcggcgcaccagccgggtccctagcgctctggggcagaggcaggaagggtctgtgcgggcatccctccccgccgagccgagcctgcagggagccctgggggccggaggaaaaggggctcaaagctcagccactgtggccgagagagcggtcaggcagcatccagccggcacgggtcccccagaacagtcacactgaccacacgcacagacacaccagagatgcccagagagacaggcagacgcactcagagatacactgaccacacgcgcagactcacacagggccagggccacacacggagacacacgcagacacacacagagccacacagagagacacatacacatgcagagacacacaaccacacacacacacagagatacacagacacacacaggaacagacagggccacacacagagacacatacacacacagagacaaacacagacacatacagagccacacagagagacacacacacacagacacaaaggaacagagccacacacggagacacacgcagacacacacagaaccacacagacacacgcagacacacacaggaacagacagaaccacacacagacacgcaaacacacacactcacatgcagaggcacacacagacacatgcagacacacacagagacaaacacacacacactcacatgcagaggcacacacagacacatgcagacacacacagagacaaacacacacacactcacatgcagaggcacacacagacacatgcagacacacacagagacaaacacacacactcacatgcagaggcacacacagacacatgcagacacacacagagacaaacacacacactcacatgcagaggcacacacagacacatgcagacacacacagagacaaacacacacacactcatatgcagaggcacacacagacacatgcagacacacacagagacaaacacacacacactcacatgcagaggcacacacagacacatgcagacacacagagacaaacacacacacatacacacatgcagaggcacacacagacacatgcagacacacagagagacacacacacacacactcacatgcagaggcacacacagacacatgcagacacacacacagagacaaacacacacacatacacacatgcagaggcacacacagacacatgcagacacacaaacacacacacactcacatgcagaggcacacacagacacatgcagacacacacacagacacccagacacagacactcagagactcacacaggaacagacacggccacatgctcaatgcagccgtactcgatcagggctcccaggcacacgccaaccccggacacacacaggaaggtggggtgggctgggagggactccgagaccccaggcctcttctcaggctcccctgggtgtggcttcattctggcgacaggggtaccccaggtctgcagtccacagcgggaggctcacctcacaccggcacacccagcactgcccaggctccacaccacagggagggcacactcacactcacacacccacccacacactcgcatgcccactcacactcacattcacacacactcacatacccactcacacacacactcgcatgcccgctcacactcacactcacactcacatacccactcacactcacacacacccactcacacacacacacacacatgcccactcacacacacactcacatgcccactcacactcacattcacacacacactcacatacccactcacacacacacacactcacatacccactcacacacacactcacatacccactcacacacacacacacactcacatacccactcacactcacgcacacacatacccactcacactcacgcacacacatacccactcacactcacacacactcacatacccactcacacacacacactcgcatgcccgctcacactcacattcaaatgcccactcacactcacatgcccactcacatgtgcactcatacacccactcacactcatattcacacacacactcacacactcacactcacacacccactcacactcacacactcatatgcccattcacactcacgtgcccactcacactcacactcacgtgcccactcatactcgcatgcccactcacactcacactcgcattcacacacctactcacacatccactcacacttgcattcaaatgcccactcacactcacatttaaatgcacactcacacacccacttgcactcacatgtccactcacacacactcacacacctactcacatgcccactcacacactcatactcgcacatccacttacatgcccactcacacacacattcacacactcacatacacacactcacactcacacacacacattcacacactcacactcacacatactcacactcacatacacactcacactcacatacacactcacacactcacactcacccattcacactcacactcacatactcacacgcccactgtcagccacacacacagcttcggcagctgctggtgagtccaacgcctgagctcctccaccctgggccgagcacgtggacccggtgccgcctcgccatgagcatggctgggagccctgccctcccacccccatcctgcacctccgtgtccccacactgccccctcccactcccacctgcccctctgggggtcactccagaccccacacctggccacagcccacagtgcaccgggagactgctgcgtggccacctgtgcccagggcctcctgcggggagcacgggcaggcgggtctgctgtgtggtccagggtccagggaggacagcaggcacaaggtgaccactgccgctctcatcctctgccgagcacctcgcctggaaacccagtcacagccaggcctgtgtctcgaccccagcactccccccaggcccgctgccagccgagggcagagcaggtgcgggcagtggctgagcccccacatgcagccccgtgggttaggtgaccccatgaagcctgaagccccttgggggaagaggtcaatgtggggccgccagttcttgaggctgggccagccatggaggccggcacctgaaacgtccctccaggctgcggcagtaggtggtgtcacagtgaaaagcagccggccctgtctctgggagggaaaggaaagtccattctgtgagggcagccccgtgtcctgtcgggcgcggcatgaggacggggtgtgaaacgcttgatgagcttatgacccaagagaaagagcgagccagggtcctgggggggaagggggggaccaggaatcccagtgaggcagccctgggggtcaggggaggtgaggcagccctggaggtcaggggaggtgaggcctcacatgcagacacacacagagacacccagccctggggggagatggggggaggtgagatagccctgggggtgagatgggggaggtgagatagccctggggtgagatgggggaggtgagatagccctgggggtcagggaggtgaggcagccctggaggtcaggggaggtgaggcagccctggggggagatggggggaggtgagatagccctggggggtgagatggggggaggtgagatagcccttgggggtgaggtgagatgggggaggtgaggcagccctgggggggtgagatagccctggggggtgagatgggggaggtgagatagcccttgggggtgaggtgagatggggggaggtgagatagccctggggggtgaggtgagatgggggaggtgagatagccctggagggtgagatgggggaggtgagatagccctggggggggggggatgggggaggtgagatagccctggggggtgaggtgagatgggggaggtgagatagccctggggggtgaggtgagatgggggaggtgagatagccctggagggtgagatgggggaggtgagatagccctggggggggatgggggaggtgaggcagccctgggggcacaagtgctgtccccacatccatcagagggtggcagggagggactgctacaggggggcagtcctggggagcagctcttcctggggtctcccctggccctcagacctgctctgcccccagccccacagtccatgaaactccccggcccaccccacagaaggccacttaggacagtcacactgtgtgttctcctgtgttacagacgttaacctcgaattccacgactgtaaactgttgagaccactcaggaggccctgggcagcagttaggcccgcaccccaaatcgagcgcgggggaccaagtcctgcctgcgctcccagccagctgggctgccggcggggcggggggcatgtcccagcccccatggagtcctgtgaaccggcagatggaggctctgtggctctgcctttcaaataaataaataaaactgaaaaactaacaaaacaaaaagccgtgcaccagaagccgcagcaggcactagggcaggggtctcatcagagatgggggcggggcggggggcgtgagggcttggccagggcgcgctctgtgacctccgctctccgcggggatcaaacgtttccttgtaagatgcaaactctgcaggctggggtctcccttcccgcatgcgccagctccgaaccccaccacgggtctccccgggcagcggacaagaccccccagcccaccccggcggccggcactcggtgcccctgccccaggagccaggagccggcgcgggccgggccgtgcgggatgggactggcggcctcgtgggaactcggtgctttagatgggtttaacaggggtgcggggagtggaggcccacgcggccgagccccgccaagtcccacccttagggtccgacggcgtcggcggcagagtctctccgctccgcggccctgggaaaccccgggcaggggaccctgggcggccaagcggatcctggggacagggcctggggagggtgggctgggggctcttgggggcgccacgtgcccgggagctggaacagggacacggctcgcgggcttccgcacacctcttcgaggcccgcggtgccccctccccgcgtgcagggcctaacgaggcagaggtgcgctctcagcacgcgggatgctgggcccagggccagcacggcgggggctgtgcggggagaggcggccgcgcagggtcctcgccgcccgctgagccgcagccccgagcccggcagggctctgctgcccccgtgtggccgccggcagccgctccacagcccggggctggactgcggcccaggcgcggcggaaggaggggacggagggcagggcggagggcggaggggacagggcgggcaacagggcgggggcagagccgggcagggtccgggaccaggtggcagttggcggctccctcgaggctcgggcgccccctcgtggcctctctcgtcccctgcactccgtgtccactgttagcgggcggcaggtcccggcccccacccagtttcccggccagcagggagtcccggggctctacatgagggccgtttggccacagcaggacagaggggcttccaacggcaagggtgagaggcgtcggcagaactggggggcgcccctttgtcccccacctgcctgcacccctgccccagcagctccttgtgggaggcgcagttcctcggaacgagggcaggggttccccgctagtgagactgtgggtacagacggggcaaggtcaggctcgggaggggcccggatccctggcaggtgccacctgcgcggctggcgcgggacgcgcgcgggtgaggccgcttgggcgccccctggtggccgcgctgcaccactgcgcgccccggatcggcctcgaggacgcgggggctccgttcggctcgcgccgggcgcctcctttaacgcaacgagccacttccgagggtgcgtggggctcgaggaaggccgttccccaagggacgccgccgaggaggggcctcggccgcctgcacgcgtgctctaagccggaggtccgcgccactagccagagcgcgctgggttcccgctggggtctgcgcctgaagcaagccgcagagagccgcgtcctccccggagccccccagagcggcggtcagcccgaagatcaggccctggaggcccgcgcccggcggagcggctggcgacgcccgcgtgcgcaccctggcggccacgagcgggacaacgcagggcgccccgcgagcgccaggagcggactcggggcaggagcgccggcgcgctctgcctttcaaatgtaaaaaaataataatgatgatgatgaaagcacctgagaatgggccaaggaaagccgcggagccccccggtgccgccaggcgcggccgcagcgccgtccccctgtgcccccggctgaccggtcagttcgggctggcaggggactgggcccgcggcaggagtcccgggaaagaggggacttgcgctgcgatggcccctggggctggaggcggcctgcggggcgcgcggaggacgcaccccacgctccccgcatttggttttgcttccacgtgaatccgggctgctcagctgtgcgtgagggcccagcagcccccatggaccagccccaggaggacgccagggggtggcttcccagcgctcttggcggcgggagaggctgggacccacgcacgctgaggctcccgcaccaggcaggcagtggggcctccagaggggagcagagacgcgggtccctgggccatccgcagggcctgacagaatctgactcccgggactggcactcagtgggcacgggggatccgagcgatgacttcagatatgaagtgatgacttcatccttgatttgaaagagttaacaggggccggtgctgtggcgaagcgtgtaaagccaccacctgcagtgctggcatcccatatgggcaccggttcaagacccggctgctccacttccgatccagctccctgcgatggcctgggaaagtagtagaagatggcccaagtccttgggcccctgcacccacgtgggagacccagaagctcctggctcctggcttcagatcggccgagctcgggctgctgtggccgtttggggagtgaaccagcggatgggagacctctctctctgcctctttgtagctctgccattcaaataaataaataaaatcttaaattaaaaaaaaaaaaaaagaggagcagccaggactcggaccggcaaccatatgggatgctggccctgcaggcaggggtgtaggcttctaccccacagcgccggccccaggcaattttgtgagcattgaaatagttgatgcacgggtaggctagtggcgcagcaggttaagcccagcctgcgatgccagcatcccacacaagcaccgactcaagggagggagacccagatggagctcctggctccaggcttcagcctgcccagccccagctgttgcagccacctggggagccaaccagcggatggaagattctctctctctgtctcctctctcctctcccagtcaagctgccttttggataagtaaataaataaatcttataaaagtcgagctggcaccaggaagagaggaagaggcggctccgtcggagtccagcggggcttggcgtcttgaattctgcaccgtgagaaagtgcggctttggcggcaggagctcccgatcgccctcagaccctgcgtctcagcgagcgggtctcaaagaccctgggtgcatcccgcacgttctacggcaaagtcagctcaggatgtaacgcccaaatctgacctgtgaaacgggtgcccttaatccagcctggggtgtgccggccaagagcgcagcgggaggcggggtgggggggttggtggggggaggggggcagaggggaggcagagggtgttggtggggggaggcgggagggggcaagaagaggcggggggggggtgcgggaggcggcagcgccggcccaggcgcccagggcagtgagctctgcagccgtctgtgccacgcgtgcgtgtggatgtgtgtgcatcgcatgcgttgctgcacatgtgtgtgcgtgtggtgtgcgtgtgcactgtgcactctgttgcgtcgtattgcatggtgcgtgtgtgcacatcacatgtgtgttgtgtgtgctgtgcgcgtgtgatccaccacgtgtacctctgtgcacgggggcgggggcagcgctagtgcccaggtcctctacttccgggggcgggagcatccccgccgcccctgcccccgggtctcctagagccgcgcgctgtgctttagttacggggtggtctcggggctgcgaggatctcctaacggctggccagggcggccgcattgcgtcactcgggttctgacgtcacgctgctttgcattcgagggattttgtgttttccctgctttccacggaataggtgatccttcttcctgccggagtgaaagctgtgcgtgttgccattgttctgagacgcgtttttaatcgcgggctcttagcaccgaatgcatcacaagccgcccgcgcagcctcggcgtctcccgcaccccgcggtgcggcctcctcccggctctgcccctttgtgtggagctcgggcaccctctggtggccacgccgcgacactgctcctgcgccggccaggtgagccttgcgggcggtcctcacattcccgccaccgccctgccagcggccctgcgtcccctctggggccacccttgctctcctctgcgcagctcgcggccccactcacctgtgtgaccccgtctcgccgcagaagaggagcacctcctcctaggaggcgtcccggggccaccctcgggcacgtgccctcacgggactgctgggcgcacctgtacgggcacctggatgcccggctcagccgcagcctccgtcagggccacgacgggacgagacaagcgccggaagccgcgcgattctccccagacggcaccggcaccaggcaggcgccagcaccaggcaggcgggagaaaggtgcaaccacactcagcgatgagcaaaccccttccacgcgtgcatgacgtgtacacgtgctgcaggtgctgctggccgccgggacacctgccggagccccagctcagccacccccagtgccccggctcggctgcccctacacaggcagggcggcgctgggtccccggcacgaagggtgaggctgacggacggcaggtgagcctcacctgatggtttctcccacaactgcatccgcacaagggcactgccatgagggcagcagagaccaagggcaccgcgggagccagagggaccggaggacgcccccggcgggtggggaccccggcccggccctccccccactcagcctctgaacacgccctgtccccgtgcagtgtctgctctcccagtcaagccctcggatcttctgagactccggctgccggcggggggatgggggggacacactgaccacgaagccaggggccttaccctggctctggtaggagcgggcactgatgcagcagtcaagacgcccacacacgtcccacattgggggtcgggccctggctgtgtgtcgagctctcaatttgcactaactcagaccctgggagccgaccggctgggtccctgccacccacgtgggagcccctaattgagttctgggctcctggggcccctggaagtgagccagagaacgtctctggctctgcctttcttcactgcgtgaggtgcagtcagcccctttgctcacaggcggtgatgctgtggacagaaagatcggaccacaggctggagcaccggagccaagctctgggccgagggtgaggctgcagaaccaacgcagccagggccaggaccacgggacagcagacagcgcagggaagtgtgaggtccacgtggagatgtggagactagggcagaagccagaatccagtgacccccagtgatgcccagtgacacccagtgatgccccagagacacccaggaacaccccagtgatgcccagtgatacccctatgatgccccagagacaccccagtgacacccagtggtgcccagtgacgcccagtgatgcccagcaatgccccagtgacccccagtgatgcccagcgatacccagtgacacccagtgacccccagtgatgccctgtgatgcccagtggtgcccagtgacccccagtggtgcccaccaacacccagtgacgcccagtagtgcccagtgatgtccagtggtgcccagcgacacccggtgacacccagtggtgcccagtgacacccagtggtgcccagttgatgcccagtgacccccagtgactgcctttggcccaagcatgtggcccgtgtgcatcctcactcagccccaggtgacgctcaagtgctgtggtcccgccctccacatggaggcgcaggtggagctcctggcccagccccggccgtcgtgggcatttgtggagtgaaccagtggctgggggctcactccctctccctcttaaaaaaatttaaaagcaaattaagtaactagatatgtaaacaataaaacaataatgtcctgggcctgggtgtggcgtagcaggtaaagccaccacctgcagtgctggcatcccatatgggcaccggttcaagtcccggctgctccatttcagatccagctccctgctatggcctgggcaagcagtagaagacggcccaagtccttgggcccctgcacatgtgtgggagacctagaagaagttcctgggtcctggcttcagatcagcatagctccagctgttgtggccaattggagagtgaaccagtggatagaagattctctctctctctctctctctgcctctgcctctcaaataaataatctttttttttttttgacagtcagagtggacagagagagagagagagacagagaaaaaggtcttcctttgctgttggttcaccctccagtggcctccgcggccggcgcgctgcagccggtgcaccacgctgatccgatggcaggagccaggtgcttctcctggtctcccatgtgggtgcagggcccaagcacttgggccatcctccactgcactccctggccacagcagagagctgacctggaagaggggcaaccgggacagaatccagcgccccgaccgggactagaacccggtgtgccggcgccgcaaggcggaggattagcctagtgagccgcggcgccggcctcaaataaataatctttaaaaatagtgatccaagcttctccctatagtgagtcgtatta

SEQ ID NO: 101 - DNA, 7351 bp, Oryctolagus cuniculus
  misc_feature (4661)...(4670): N=A, T, G, C
gcccctggcctgccctgaataaactccgtgctcgcccccagcagccctgcgggttcattgtgccagtctgtctcctcgggggctgcagccacagggcagggagggggagtgcccctggacctaggagctggggtctcgggcacctataggggacatcatgcatggtgcccgtgagtgtgcatgtgagtgtgagtgtgagcaaatgtgcctgtgggagtgagtgtgtctgggagtgagtgtgtctaggagtgagtgtgcctgggagtgggtgtgtctgggagtgggtgtgtctgggagcgggtatctgggagtgggtatctgggagtcagtgtgtctgggagtgagtgtgtctaggagtgagtgtgtctgggagtgagtgtgtagggagtgagcgtgtctgggagtcagtgtgtctgggagtgggtgtgtctgggagtgggtgtgtctgggagtgagtgtgtagggagtgagtgtgtctgggagtgagtgtgtctgggagggagcagtgagaggggaggctgagccggggtggattctgaggcagtgcaggcacagctcaggtcgcacccagagccgtggacaccagcaggagttcctgggcggcaggggtgcagccattgccctggtgcagaggacgagggagggagggggaggaacagggggtgtgcagggacccctgggaagaaggtgtccacaggccccacagcccagcagtgcaggacagcgctgacacacacagggcacacagcaggccccaccccgcaccacgctctctggggcctgcacacggcacacgtgctcacagggcacacacgctcacacacgtccccctcagctgcaggagagctcacagcccagacacagctccaggaaggcaggggcgtccccgcccgagccccagacggtttccccaagcccagccctgctgcccaggcccctgctgctcctctctgggcctccctgaatgtccagccatgcacagttcaaggatcatttgcacagcccaccctagacaggccctgctcactgctgggcccccagactcaaccctctaatcccctcctgagcccgagtctgagccaaaccacaggcagagaggggcaggacagagaccacccactcaggcccctcctcaggccttgggcttctgtttgcaccccagaagctctcaggccaatgtaggaatcccgggcaccaggactccaacagggcaccaggccccagctcttgcctaagccaatgattctcaggaactgagccaaaagagcagcctcctaaggaaagagagaaagggggagaattatcatggagagcagacagataagcctatgaccctaagacagtggaccatggatggacagatggacaggtggagggatggatcagtggataaatgcacaggtagatagatggctgggttaatgttagctgggtggatttttggatatgtagttagagagatggatggatgacagctttattgttgagtgaaatggtggataaatagataacagattgattgatatgatcagatattcagttataagacaaactggtcaactccaatttaacacagagatccgtgacccaggacctaggacgtctggtccactctgctggctgctggctgctggccttcgctggccgtccctcagccacttccctggggaagaacagaggctctgctcacaccatggtccctgctcatgccctgggcacactgaccccacactcagaccctgaggtgtgcctggtcctctctggacccaggtcccggccaaggccagcccaagagcagggcttaggcaggagccactgagtacgtggctcagctcaggacagcagggctccggccacaccttccctggaccagcaaggacactgccccgcctcctgtcctgcagctgcgctaagacacttgcaggggccaaccccctatgggccctgctctcaccctcagaccccatagagaccccaccactccacccccaggccccgaggaggcgtgggagagaaggccttgggccaggccccacccacacgtcaggtcctggcaggccttctgtgtcttgcaggttgtcaggagcccctgccctgtgtggtgctggatctgccacaggacagcctggaggaggaggcccccggcgccaacctgtggcccaccaccgtcaccctcctcactctcttcctgctgagcctgttctacagcacagctctgaccgtgaccagcatccggggcccgccttgcagcaaagagggaccccagtactgaggcacaggtgtggggatgccctggggagggggtccgggcccaagcagaggtgactgctgctgccatagaggggcacaggggtccctgcaggaactgggacatgggtgccctggggtcagggtgggagcgtccccggggggatgctgaggattccaccaaggctcccgggagccaggcccgggctgggacaggggagagcggtgaggacaccgcccaccctcagctgcccctgtctctgcaggagggaagcgtgcaggagcccctgggaaagccagctctgcatgccagagcccagccctccatgaagcagtgaccccccatccccctgtcaggtgcactcaacccttcccagacgaatgttctcgctctgctggacgatggctcagggaagccacgtgacttcagactgggagacgcctgccactccaacacagggacttcagcatggactggacgcggtgccccagacacggcctggccctcaggagtctcaagtccaagaccagtgcttcacctgggagggctcagaaggacgcctccctggagtggccattgaactggtctgagcactgggccctggtcctgatctctttgacctggtccttatctctgagccctggtcctattatctgatccctggtcttgatgaatgaatttttctggatagtgggccctggtcattaccactgagccctggtcctgtgcactgggccctggtcttcctcactgagccctggtcctgcacactgagccctggtcttcctcactgagccctggtccttaccactgagctctcttcctcttaactgagcagattcgtgtcactgagcaatggttctgatgactgaaccctggtcttgagcactcgccttggttctcattactaagccctgttccagatattggaccctggtcctgctcactgagccctggtcctgagcactgagccctggtcctgagtactgagccctggtcctggtcactgggcccagattctgctcactgggccctggtccttatctctgagcccaggtcgtattatctgatccctggtcttgatgactgaatgtggtctggatattgggccctggacatgacaactgagccctggtcctgctctctgagccctggtcctgagccctggtcctgctctctgggccctggtcctgagtctggtcctgatcctgggcctcgccccatcgcacacaccaggactcctcctgagctgcatcctctaaggctctgactttgcacacatcctgagccctgagtgctgaccgctctaggacgtgacctgcaggaaggccgcagccctcagggaggccccagcaggcaccgcttgcaggtgcagtcacggccgcactcctcatcctcactccgtcctctcaggccctgaggggttgcaggggtggagaggggacaagcccaggccccgggctgcctgaggtggactcagtgcctgcggtccccgggtcaggggtgcagcgcaggtgggaccgaggaggacggacggtcgtgttgttttcccctgtgttgctccttcttcagaagcttcctgtgcccgtgcacctgctgaaacccctgaaatagccctgggccggctgagtcatcccaggcacagcccaggtgtccccgctgagacccctgtcctcaggccctccacggaggcctggccagattgccccgaggcctgggcaaggacggacagcaccatggggaccatggggccctcgcacccctcaggccagggtttcacggacggcacccaccagccccagccaggcttcaggaaggccaagagctcaggttagccgggaccagcctggcttccggcagggtcagaccaggccccgctggcttccaccaggtcaggccatctcagccaggccgtctccctggggcactgacccacagcacagcagacccacggggacccgggctagcacctgccaccgcacctcagcgtccccctgcccgtgtcagagctgatgaagggcacagttccagactccacccccaggctggctccaggacaggcacaacccagggctccaggaaagacctgcatcccacacttgggacttgaactctggaaacgggtgactgagccaaggtccctcagaaagggtgactaagccagggtcggggagaggaagcaggtggagacagaaaggaaaagagacagagacaggaagggagagagatggacaagaataactgacaggatgggacccactgtgaggacgacacgaatgcagacagccgactacagggtgaacgcaccaggcacgtgtccagcacgtgagaccacagtgaagaagcccccatcccacacctcgtctctgggtgtacttccggctccatcccaacgcagctcccgctggtcagnnnnnnnnnntgtgtgtgtctgtgtccctgtgtgtgtgtgtctctgtgtgtgtccctgtgtgtgtccctgtgtgtgtctgtgtccctgtgtgtgtccctgtgtgtgtctgtgtccctgtgtgtgtctgtgtccctgtgtgtgtctgtgtccctgtgtgtgtgtctctgtgtgtgtctatgtccctgtgtgtgtgtctctgtgtgtgtgtgtctctgtgtgtgtctgtgtccctgtgtgtgtctgtgcctggcctgtgcaggtgtttgctcagctccctgcatggacagagtctgcagactcaggtccccagctccacggggcctaggactactacggggccaaggccactcagggtagggctgaggcctgggccacccagaggttgcaggggaaagggctggagaggaggccccagcctgtgacagcgtgagacaccccgggaagaccaggctgggagacccaccgagagacaggggctctcagattcaggggcaaacagagccggctggggttcccacaccactcacacaacacagcctcacactcatacaacctcaccctgcaacacacacactcacacttggaccctcccccacacctgctcactcacagcagccacacaaatccacactcactcatgacacacaggtacacacgcacacaacacttacacactcatactcacacactcacactcatacacacactcaatcccaacacacaaagactaggtctccacaacacacactcacccctacactcactcgcaacattcacacacactcaaaaattcatacccccctcagctcacacacacaatcagacccccactcactctcaacacacactcagacccccactcactcctagccctcacaggcacactcacagctgtattaactcccacacactcacacccactctctcactctcaacagtcactcacacccacactcatacacacactctcaacactcgcacactcatcacttttaccaacatttcacacaaacaccctctctcaccatccctcactcacagtcactcacgtgctcacactcatgcacccccacgcacacgcatgcccacctcactctgacatacccactcacatactttcccttgcacgctcacactctcactcccacacttacacgcacgtgctcacacccacggcctccctcccttggactcagagtcaccctgaggctcagggctgagtaacaggtcccactgctcctgctgtggcccccacgtcctgtctggggatcccatctgtgagcagggcacatgtgccctgagggcagcacccacccagggcctggctcagggtgggctgtgagctctgacggcacaggacaaaggggcaggtgggctggcagccagtgccgccaagccagcgctggttggaccctggggggttggtctgcggctgggggcagagcagcacagggagccacccccacctgccaggcaggcccccggggtggctggacacccgttggctcccactctgtcccaaccactgggtggccaggcaggcagctggggacccacatggggccccaaacacggggcagggcaggtggggacgggagagcaggagggcctgggaccctggggtgctggatgccagcccgggggctcaggcctgaggctgacgtgggcccctcaggaggggctgggcagcccggacagtcacagagggcacacacaggggacgtggtctgaggaggggagggaggctgcaggccacaggaccagtgtcctggagggacctggggggccgcgatctgtgggaaggggctcgagtgaggctcctcccaccccagtgcagcggcagcagagaggagggaagacgggtgggacaggagggcgcaggctgctggacccgcgggggctcgaggtgggggcctcggctttgcctcaactgagccgaggagcaggggctgccgtccggagaaggcacggggcggcaggaggtggagagcgttttgggtggggcccagggtcctgggcagagtggaggcgggagagcgttggccctttgaggacagagacctggagcctggccatctcctgcctgtcctcgggcagctccccccactggccgctcacgccccgaggccctctgacctgcaccagacggggcgtggggagggggcccaagacccgggcccacaccctgggcagcgtgccgtgggggccaggggtccatcctgaagggtgacgcggggacaagacaggatggaggcgcccaggggcccggggcccacccacagctcagcctacacccagctcccccgctctcccagacaccacgggggcccccgtgaccctcggcgtgccacccgccaaggttggcaagtctctgtccctctcagtcaggcctcccgggtcacccagtcccccagaactccccatcctcagtggggacgacgcagcctcgcccaaatcacactgacactcgggccccaccctggtcccgcaggctgagccgctgcccctctctggagcccccgagggcactgcccaccaggctcccggccgtgcccacgggcagtggtggggctttgccggggcccagcccctggtggggcctggctgaaggctctggtgccctgccttatctctcaaggggctgcaaggtgggggtctcctgtctccttcatgccccttcacgtgttggc

SEQ ID NO: 102 - DNA, 12927 bp, Oryctolagus cuniculus
  misc_feature (4661)...(4670): N=A, T, G, C
  misc_feature (11224)...(11233): N=A, T, G, C
gcccctggcctgccctgaataaactccgtgctcgcccccagcagccctgcgggttcattgtgccagtctgtctcctcgggggctgcagccacagggcagggagggggagtgcccctggacctaggagctggggtctcgggcacctataggggacatcatgcatggtgcccgtgagtgtgcatgtgagtgtgagtgtgagcaaatgtgcctgtgggagtgagtgtgtctgggagtgagtgtgtctaggagtgagtgtgcctgggagtgggtgtgtctgggagtgggtgtgtctgggagcgggtatctgggagtgggtatctgggagtcagtgtgtctgggagtgagtgtgtctaggagtgagtgtgtctgggagtgagtgtgtagggagtgagcgtgtctgggagtcagtgtgtctgggagtgggtgtgtctgggagtgggtgtgtctgggagtgagtgtgtagggagtgagtgtgtctgggagtgagtgtgtctgggagggagcagtgagaggggaggctgagccggggtggattctgaggcagtgcaggcacagctcaggtcgcacccagagccgtggacaccagcaggagttcctgggcggcaggggtgcagccattgccctggtgcagaggacgagggagggagggggaggaacagggggtgtgcagggacccctgggaagaaggtgtccacaggccccacagcccagcagtgcaggacagcgctgacacacacagggcacacagcaggccccaccccgcaccacgctctctggggcctgcacacggcacacgtgctcacagggcacacacgctcacacacgtccccctcagctgcaggagagctcacagcccagacacagctccaggaaggcaggggcgtccccgcccgagccccagacggtttccccaagcccagccctgctgcccaggcccctgctgctcctctctgggcctccctgaatgtccagccatgcacagttcaaggatcatttgcacagcccaccctagacaggccctgctcactgctgggcccccagactcaaccctctaatcccctcctgagcccgagtctgagccaaaccacaggcagagaggggcaggacagagaccacccactcaggcccctcctcaggccttgggcttctgtttgcaccccagaagctctcaggccaatgtaggaatcccgggcaccaggactccaacagggcaccaggccccagctcttgcctaagccaatgattctcaggaactgagccaaaagagcagcctcctaaggaaagagagaaagggggagaattatcatggagagcagacagataagcctatgaccctaagacagtggaccatggatggacagatggacaggtggagggatggatcagtggataaatgcacaggtagatagatggctgggttaatgttagctgggtggatttttggatatgtagttagagagatggatggatgacagctttattgttgagtgaaatggtggataaatagataacagattgattgatatgatcagatattcagttataagacaaactggtcaactccaatttaacacagagatccgtgacccaggacctaggacgtctggtccactctgctggctgctggctgctggccttcgctggccgtccctcagccacttccctggggaagaacagaggctctgctcacaccatggtccctgctcatgccctgggcacactgaccccacactcagaccctgaggtgtgcctggtcctctctggacccaggtcccggccaaggccagcccaagagcagggcttaggcaggagccactgagtacgtggctcagctcaggacagcagggctccggccacaccttccctggaccagcaaggacactgccccgcctcctgtcctgcagctgcgctaagacacttgcaggggccaaccccctatgggccctgctctcaccctcagaccccatagagaccccaccactccacccccaggccccgaggaggcgtgggagagaaggccttgggccaggccccacccacacgtcaggtcctggcaggccttctgtgtcttgcaggttgtcaggagcccctgccctgtgtggtgctggatctgccacaggacagcctggaggaggaggcccccggcgccaacctgtggcccaccaccgtcaccctcctcactctcttcctgctgagcctgttctacagcacagctctgaccgtgaccagcatccggggcccgccttgcagcaaagagggaccccagtactgaggcacaggtgtggggatgccctggggagggggtccgggcccaagcagaggtgactgctgctgccatagaggggcacaggggtccctgcaggaactgggacatgggtgccctggggtcagggtgggagcgtccccggggggatgctgaggattccaccaaggctcccgggagccaggcccgggctgggacaggggagagcggtgaggacaccgcccaccctcagctgcccctgtctctgcaggagggaagcgtgcaggagcccctgggaaagccagctctgcatgccagagcccagccctccatgaagcagtgaccccccatccccctgtcaggtgcactcaacccttcccagacgaatgttctcgctctgctggacgatggctcagggaagccacgtgacttcagactgggagacgcctgccactccaacacagggacttcagcatggactggacgcggtgccccagacacggcctggccctcaggagtctcaagtccaagaccagtgcttcacctgggagggctcagaaggacgcctccctggagtggccattgaactggtctgagcactgggccctggtcctgatctctttgacctggtccttatctctgagccctggtcctattatctgatccctggtcttgatgaatgaatttttctggatagtgggccctggtcattaccactgagccctggtcctgtgcactgggccctggtcttcctcactgagccctggtcctgcacactgagccctggtcttcctcactgagccctggtccttaccactgagctctcttcctcttaactgagcagattcgtgtcactgagcaatggttctgatgactgaaccctggtcttgagcactcgccttggttctcattactaagccctgttccagatattggaccctggtcctgctcactgagccctggtcctgagcactgagccctggtcctgagtactgagccctggtcctggtcactgggcccagattctgctcactgggccctggtccttatctctgagcccaggtcgtattatctgatccctggtcttgatgactgaatgtggtctggatattgggccctggacatgacaactgagccctggtcctgctctctgagccctggtcctgagccctggtcctgctctctgggccctggtcctgagtctggtcctgatcctgggcctcgccccatcgcacacaccaggactcctcctgagctgcatcctctaaggctctgactttgcacacatcctgagccctgagtgctgaccgctctaggacgtgacctgcaggaaggccgcagccctcagggaggccccagcaggcaccgcttgcaggtgcagtcacggccgcactcctcatcctcactccgtcctctcaggccctgaggggttgcaggggtggagaggggacaagcccaggccccgggctgcctgaggtggactcagtgcctgcggtccccgggtcaggggtgcagcgcaggtgggaccgaggaggacggacggtcgtgttgttttcccctgtgttgctccttcttcagaagcttcctgtgcccgtgcacctgctgaaacccctgaaatagccctgggccggctgagtcatcccaggcacagcccaggtgtccccgctgagacccctgtcctcaggccctccacggaggcctggccagattgccccgaggcctgggcaaggacggacagcaccatggggaccatggggccctcgcacccctcaggccagggtttcacggacggcacccaccagccccagccaggcttcaggaaggccaagagctcaggttagccgggaccagcctggcttccggcagggtcagaccaggccccgctggcttccaccaggtcaggccatctcagccaggccgtctccctggggcactgacccacagcacagcagacccacggggacccgggctagcacctgccaccgcacctcagcgtccccctgcccgtgtcagagctgatgaagggcacagttccagactccacccccaggctggctccaggacaggcacaacccagggctccaggaaagacctgcatcccacacttgggacttgaactctggaaacgggtgactgagccaaggtccctcagaaagggtgactaagccagggtcggggagaggaagcaggtggagacagaaaggaaaagagacagagacaggaagggagagagatggacaagaataactgacaggatgggacccactgtgaggacgacacgaatgcagacagccgactacagggtgaacgcaccaggcacgtgtccagcacgtgagaccacagtgaagaagcccccatcccacacctcgtctctgggtgtacttccggctccatcccaacgcagctcccgctggtcagnnnnnnnnnntgtgtgtgtctgtgtccctgtgtgtgtgtgtctctgtgtgtgtccctgtgtgtgtccctgtgtgtgtctgtgtccctgtgtgtgtccctgtgtgtgtctgtgtccctgtgtgtgtctgtgtccctgtgtgtgtctgtgtccctgtgtgtgtgtctctgtgtgtgtctatgtccctgtgtgtgtgtctctgtgtgtgtgtgtctctgtgtgtgtctgtgtccctgtgtgtgtctgtgcctggcctgtgcaggtgtttgctcagctccctgcatggacagagtctgcagactcaggtccccagctccacggggcctaggactactacggggccaaggccactcagggtagggctgaggcctgggccacccagaggttgcaggggaaagggctggagaggaggccccagcctgtgacagcgtgagacaccccgggaagaccaggctgggagacccaccgagagacaggggctctcagattcaggggcaaacagagccggctggggttcccacaccactcacacaacacagcctcacactcatacaacctcaccctgcaacacacacactcacacttggaccctcccccacacctgctcactcacagcagccacacaaatccacactcactcatgacacacaggtacacacgcacacaacacttacacactcatactcacacactcacactcatacacacactcaatcccaacacacaaagactaggtctccacaacacacactcacccctacactcactcgcaacattcacacacactcaaaaattcatacccccctcagctcacacacacaatcagacccccactcactctcaacacacactcagacccccactcactcctagccctcacaggcacactcacagctgtattaactcccacacactcacacccactctctcactctcaacagtcactcacacccacactcatacacacactctcaacactcgcacactcatcacttttaccaacatttcacacaaacaccctctctcaccatccctcactcacagtcactcacgtgctcacactcatgcacccccacgcacacgcatgcccacctcactctgacatacccactcacatactttcccttgcacgctcacactctcactcccacacttacacgcacgtgctcacacccacggcctccctcccttggactcagagtcaccctgaggctcagggctgagtaacaggtcccactgctcctgctgtggcccccacgtcctgtctggggatcccatctgtgagcagggcacatgtgccctgagggcagcacccacccagggcctggctcagggtgggctgtgagctctgacggcacaggacaaaggggcaggtgggctggcagccagtgccgccaagccagcgctggttggaccctggggggttggtctgcggctgggggcagagcagcacagggagccacccccacctgccaggcaggcccccggggtggctggacacccgttggctcccactctgtcccaaccactgggtggccaggcaggcagctggggacccacatggggccccaaacacggggcagggcaggtggggacgggagagcaggagggcctgggaccctggggtgctggatgccagcccgggggctcaggcctgaggctgacgtgggcccctcaggaggggctgggcagcccggacagtcacagagggcacacacaggggacgtggtctgaggaggggagggaggctgcaggccacaggaccagtgtcctggagggacctggggggccgcgatctgtgggaaggggctcgagtgaggctcctcccaccccagtgcagcggcagcagagaggagggaagacgggtgggacaggagggcgcaggctgctggacccgcgggggctcgaggtgggggcctcggctttgcctcaactgagccgaggagcaggggctgccgtccggagaaggcacggggcggcaggaggtggagagcgttttgggtggggcccagggtcctgggcagagtggaggcgggagagcgttggccctttgaggacagagacctggagcctggccatctcctgcctgtcctcgggcagctccccccactggccgctcacgccccgaggccctctgacctgcaccagacggggcgtggggagggggcccaagacccgggcccacaccctgggcagcgtgccgtgggggccaggggtccatcctgaagggtgacgcggggacaagacaggatggaggcgcccaggggcccggggcccacccacagctcagcctacacccagctcccccgctctcccagacaccacgggggcccccgtgaccctcggcgtgccacccgccaaggttggcaagtctctgtccctctcagtcaggcctcccgggtcacccagtcccccagaactccccatcctcagtggggacgacgcagcctcgcccaaatcacactgacactcgggccccaccctggtcccgcaggctgagccgctgcccctctctggagcccccgagggcactgcccaccaggctcccggccgtgcccacgggcagtggtggggctttgccggggcccagcccctggtggggcctggctgaaggctctggtgccctgccttatctctcaaggggctgcaaggtgggggtctcctgtctccttcatgccccttcacgtgttggctgggaaccttctagaaggaggtgattgtcgggacctcacaggagcgggtgaggctgatggtggattctccttacccacaagttcaggacagggagggacccaggtgcagagagagagagagagagagggacagagagggacagggacagagtgggtctgtgacagggacggggtggagggagctcaagagaggcaagatggagtgtgtgacgctgccgcgggggcggtgagatgtgggggctcaggcagggagctcatccagagagggggagagatggcccagacagggatgggggtgacgggtggtgcgtgggggccccgctgacatcaggcagctgcccggccctgctgagcctgtgtgctcgtcagggacatgtgagtagggagtggggcgtggggccctgggtcacccggggcgtccagccccacccctggggtccccgttggtgctggccgagggccctgtggttgagcctgtggcccctgggctgctcagggagccctgatcgcgaagggacacttggggccgagaccccctgagcttgctgaggccggcattcaccacgccgcgggcacaggcctggcctggcctggccatgggggtgcagccgggcggggccgcaggtggagaccggcagctatttctggaaacagcctcggtgggcgagaagcacgctttctggagtggaaccgcatttgcatgcgcctgtgagggccgagtgtgcccggaatgagtcacctggggaggatctcacacctgcggggggggggggggtgctgacacgcagcccccagcccccggggcagcagctgccatcagcagcaccatcttggaagacccccagggcgctgggcaggccccccagggcagacaagaacacgttgccaggaggggtctcagccagtgtggacgggacccccccccgggacccgggtcacaggggaggcagcagctgttggtccttggggctcagggctccagggtttggggtcctggggtgcactcagcactggtcctgccagggagtctgcagccctgaacgtgggcagatgtggccaaccttggcgggggctgggaaggcagggacagcaggccctggggaggcactcgagggggtagtgtgtgcctggtggtccaggcaggaggaccgcggagtctgagggagcccaggtggggatcccaacccggggctggggacaagcaattcgtgttccagaaagatccctcaaacatggggggagggggcttcttactctgaaaactggaaagtgaacaggcacaggcagcctcactccgcctctgtccccctctccccccttctctctctgtccccccccctccctctctctctgtccccccctctctccctctctctctgtcccccctctctgtgtccccctctccctgtccctctctctctgtcactctctctcaatctctctctgtccccctccgtgtccatctctatctctctatccctctctctttctctttgtcttccccctctgcctctctctttctccatctctttgtctctgtctctctctgtccctccctccctctctcctctctccctctccccgtgtgtgtgtgtgtgtgtgtgcgcacgtgtgtgtgtgtgtctgtccctctctctctctctctctctgcacctgggtccctccctgtcctgaacttgtgggtaaggagacgccaccatcagcctcacccgctcctgtgaggtcccgacaatcacctccttctagaaggttcccagccaacacgtgaaggggcgtgaaggagacaggagacccccaccttgcagccccttgagagataagacagggcaccagagccttcagccaggccccaccaggggctgggccccggcaaagccccaccactgcccatgggcacggccgggagcctggtgggcagtgccctcgggggctccagagaggggcagcggctcagcctgcggggccagggtggggcccgagtgtcagtgtgatttgggcgaggctgcgtcgtccccactgaggatggggagttctgggggactgggtgacccgggaggcctgactgagagggacagagacttgccaaccttggcgggtggcacgccgagggtcacgggggcccccgtggtgtctgggagagcgggggagctgggtgtaggctgagctgtgggtgggccccgtggcccctgggcgcctccatcctgtcttgtccccgcgtcacccttcaggatggacccctggcccccacggcacgctgcccagggtgtgggcccgggtcttgggccccctccccacgccccgtctggtgcaggtcagagggcctcggggcgtgagcggccagtggggggagctgcccgaggacaggcaggagatggccaggctccaggtctctgtcctcaaagggccaacgctctcccgcctccactctgcccaggaccctgggccccacccaaaacgctctccacctcctgccgccccgtgccttctccggacggcagcccctgctcctcggctcagttgaggcaaagccgaggcccccacctcgagcccccgcgggtccagcagcctgcgccctcctgtcccacccgtcttccctcctctctgctgccgctgcactggggtgggaggagcctcactcgagccccttcccacagatcgcggccccccaggtccctccaggacactggtcctgtggcctgcagcctccctcccctcctcagaccacgtcccctgtgtgtgccctctgtgactgtccgggctgcccagcccctcctgaggggcccacgtcagcctcaggcctgagcccccgggctggcatccagcaccccagggtcccaggccctcctgctctcccgtccccacctgccctgccccgtgtttggggccccatgtgggtccccagctgcctgcctggccacccagtggttgggacagagtgggagccaacgggtgtccagccaccccgggggcctgcctggcaggtgggggtggctccctgtgctgctctgcccccagccgcagaccaaccccccagggtccaaccagcgctggcttggcggcactggctgccagcccacctgcccctttgtcctgtgccgtcagagctcacagcccaccctgagccaggccctgggtgggtgctgccctcagggcacatgtgccctgctcacagatgggatccccagacaggacgtgggggccacagcaggagcagtgggacctgttactcagccctgagcctcagggtgactctgagtccaagggagggaggccgtgggtgtgagcacgtgcgtgtaagtgtgggagtgagagtgtgagcgtgcaagggaaagtatgtgagtgggtatgtcagagtgaggtgggcatgcgtgtgcgtgggggtgcatgagtgtgagcacgtgagtgactgtgagtgagggatggtgagagagggtgtttgtgtgaaatgttggtaaaagtgatgagtgtgcgagtgttgagagtgtgtgtatgagtgtgggtgtgagtgactgttgagagtgagagagtgggtgtgagtgtgtgggagttaatacagctgtgagtgtgcctgtgagggctaggagtgagtgggggtctgagtgtgtgttgagagtgagtgtgagtgtgtgattgttgagaatgagcggtggtgtgtgagtgtgtgcatacgagtgtgcaaagcatgggtgtgcgatgtgcttcatgaggcttctgctcttgtcactgccagttttttcccctgtattgatggctcttgactcttttactcttaaaaataacgtggtttatttatttatttatttatttatttatttatttatttattatttgagaggcagaaagtgagtagagagtcgagagagcagaggaaannnnnnnnnnggacacactcagacacacacagacaaacacacagggacacactcagacacacacagggacacagagagacacatatagggacacacacagacacacacacagacacacacagggacacaaacatagggacatgcacacagacacacacatagacacagagagacacacagggacacagagagacacacagggacacactcagagacacacacagagacacacacacagggacacatgcacagagacacacagagacacacagggacacacacagacaacagggacacactcagacacacacagggacacacagacacacacagggacacagggacacactcagacacacacagaaagacacacacagggacacacacagaaagacacacagagggacacacacagagggacacacagggacacacacacagagacacacagagggagacacacacagacacatgcagatacacaccacctacacaaccaagtcacacacacatatgaatacacacatatatgggcacacacagagacatacccacatgctcagacacacacagagacacagagattcacacacacacatatatggacacacacagacacacacacatatggatacacacagatactcagacacacagatacacatacacatggaaacacacagacacacacctacaatctcagacacacagagacagagacacacacagacaccgacaggctcagacacacacaatcacacacatacacagaaacaaaaagaaaaacactcacagattcgcacacactcagacacacacaagtgaagatacactcacactcacacacatgcagatacagacacacccagatacacctcaacacactctgatacacagatacactcacacacactcggataaacacacagacacacacatatgtgttcacacactcagacactcaggccccacagccccagcagtgccctcccaactgccctgcccttcagccctggccctgcgccttccaagtagccagggggcctgggcagagtggacagagacaagtctggggctggggacggtgaagtcaggcctggaaggatgagaggggtttgcccgcccacccgggagcccccgcacacctgcacacacaccacacgcagcttccacttgtggctcacgctcatgctcacacgcacactcctgcacacgcgcgcgtggtgtggctgggccgggctttggcgtgtggggtcagggagagctggcagagggagtgcctcggccattctgggccagtcgggctgcaggcgggggtccaggcacagggcagcggcacctcagtaccatgagggcagctcagactggcatcgtgtggggtcaccatagcattgcacacgtgtgttcctggcatgtcgcatgtgcgcatgtgagggactcctagggtggtctccccagggcgttggcacacgacgcctgggcccctagctcagggacacagtggggccggaagcttctgtctactgaccagccctgggccggctctgttgtgaacactaggcagagccaggccgcactcagaattggcatctggaccacccgggggcccctcaaaacagctccacacctgaccagggtgggctgtacacccggggggcccagccgggaccctcatgccggatgcctggagcagagccccggctc

SEQ ID NO: 103 - DNA, 11807 bp, Oryctolagus cuniculus
ccggtgtgggcacccagctgtggctcccacccacgctgtgcaccgggacaaacaagcacttgcaaatgtttctaaaatcgggaagtgcgggaaccacagagcaggtggggcccggggtggaaagccccactcacccctgagaccgaaactggagaagccaggactgtgggggatttgcattgggggagggggcaagccaggctgcttgggaggactgctaaccctcccagcccccaccctgccacctcagctagccaggcctgtgctgtggcgtggccaggcccagagtgaccagagccaccagaccccaggagcgcttcccagagaagaaacctcgtgtaagggcacggggggcttccctgcccaggcagaacgcggggccagccggccgcccctgggggaaggggctcacattcaggcccttgacaacctgctctgtgtccaagctttgtccctgctgtgcccacactggaccatcccagccagcttcaaggcacggcccctcgggcacgtccacccccagcctcaggattccctgggcctcgcaacagctgcccccgaccagacctgcctgagcccagccccgtgcgccgggggacacagaggcctgtgcgacccaccccactccggccctcggcgcaccagccgggtccctagcgctctggggcagaggcaggaagggtctgtgcgggcatccctccccgccgagccgagcctgcagggagccctgggggccggaggaaaaggggctcaaagctcagccactgtggccgagagagcggtcaggcagcatccagccggcacgggtcccccagaacagtcacactgaccacacgcacagacacaccagagatgcccagagagacaggcagacgcactcagagatacactgaccacacgcgcagactcacacagggccagggccacacacggagacacacgcagacacacacagagccacacagagagacacatacacatgcagagacacacaaccacacacacacacagagatacacagacacacacaggaacagacagggccacacacagagacacatacacacacagagacaaacacagacacatacagagccacacagagagacacacacacacagacacaaaggaacagagccacacacggagacacacgcagacacacacagaaccacacagacacacgcagacacacacaggaacagacagaaccacacacagacacgcaaacacacacactcacatgcagaggcacacacagacacatgcagacacacacagagacaaacacacacacactcacatgcagaggcacacacagacacatgcagacacacacagagacaaacacacacacactcacatgcagaggcacacacagacacatgcagacacacacagagacaaacacacacactcacatgcagaggcacacacagacacatgcagacacacacagagacaaacacacacactcacatgcagaggcacacacagacacatgcagacacacacagagacaaacacacacacactcatatgcagaggcacacacagacacatgcagacacacacagagacaaacacacacacactcacatgcagaggcacacacagacacatgcagacacacagagacaaacacacacacatacacacatgcagaggcacacacagacacatgcagacacacagagagacacacacacacacactcacatgcagaggcacacacagacacatgcagacacacacacagagacaaacacacacacatacacacatgcagaggcacacacagacacatgcagacacacaaacacacacacactcacatgcagaggcacacacagacacatgcagacacacacacagacacccagacacagacactcagagactcacacaggaacagacacggccacatgctcaatgcagccgtactcgatcagggctcccaggcacacgccaaccccggacacacacaggaaggtggggtgggctgggagggactccgagaccccaggcctcttctcaggctcccctgggtgtggcttcattctggcgacaggggtaccccaggtctgcagtccacagcgggaggctcacctcacaccggcacacccagcactgcccaggctccacaccacagggagggcacactcacactcacacacccacccacacactcgcatgcccactcacactcacattcacacacactcacatacccactcacacacacactcgcatgcccgctcacactcacactcacactcacatacccactcacactcacacacacccactcacacacacacacacacatgcccactcacacacacactcacatgcccactcacactcacattcacacacacactcacatacccactcacacacacacacactcacatacccactcacacacacactcacatacccactcacacacacacacacactcacatacccactcacactcacgcacacacatacccactcacactcacgcacacacatacccactcacactcacacacactcacatacccactcacacacacacactcgcatgcccgctcacactcacattcaaatgcccactcacactcacatgcccactcacatgtgcactcatacacccactcacactcatattcacacacacactcacacactcacactcacacacccactcacactcacacactcatatgcccattcacactcacgtgcccactcacactcacactcacgtgcccactcatactcgcatgcccactcacactcacactcgcattcacacacctactcacacatccactcacacttgcattcaaatgcccactcacactcacatttaaatgcacactcacacacccacttgcactcacatgtccactcacacacactcacacacctactcacatgcccactcacacactcatactcgcacatccacttacatgcccactcacacacacattcacacactcacatacacacactcacactcacacacacacattcacacactcacactcacacatactcacactcacatacacactcacactcacatacacactcacacactcacactcacccattcacactcacactcacatactcacacgcccactgtcagccacacacacagcttcggcagctgctggtgagtccaacgcctgagctcctccaccctgggccgagcacgtggacccggtgccgcctcgccatgagcatggctgggagccctgccctcccacccccatcctgcacctccgtgtccccacactgccccctcccactcccacctgcccctctgggggtcactccagaccccacacctggccacagcccacagtgcaccgggagactgctgcgtggccacctgtgcccagggcctcctgcggggagcacgggcaggcgggtctgctgtgtggtccagggtccagggaggacagcaggcacaaggtgaccactgccgctctcatcctctgccgagcacctcgcctggaaacccagtcacagccaggcctgtgtctcgaccccagcactccccccaggcccgctgccagccgagggcagagcaggtgcgggcagtggctgagcccccacatgcagccccgtgggttaggtgaccccatgaagcctgaagccccttgggggaagaggtcaatgtggggccgccagttcttgaggctgggccagccatggaggccggcacctgaaacgtccctccaggctgcggcagtaggtggtgtcacagtgaaaagcagccggccctgtctctgggagggaaaggaaagtccattctgtgagggcagccccgtgtcctgtcgggcgcggcatgaggacggggtgtgaaacgcttgatgagcttatgacccaagagaaagagcgagccagggtcctgggggggaagggggggaccaggaatcccagtgaggcagccctgggggtcaggggaggtgaggcagccctggaggtcaggggaggtgaggcctcacatgcagacacacacagagacacccagccctggggggagatggggggaggtgagatagccctgggggtgagatgggggaggtgagatagccctggggtgagatgggggaggtgagatagccctgggggtcagggaggtgaggcagccctggaggtcaggggaggtgaggcagccctggggggagatggggggaggtgagatagccctggggggtgagatggggggaggtgagatagcccttgggggtgaggtgagatgggggaggtgaggcagccctgggggggtgagatagccctggggggtgagatgggggaggtgagatagcccttgggggtgaggtgagatggggggaggtgagatagccctggggggtgaggtgagatgggggaggtgagatagccctggagggtgagatgggggaggtgagatagccctggggggggggggatgggggaggtgagatagccctggggggtgaggtgagatgggggaggtgagatagccctggggggtgaggtgagatgggggaggtgagatagccctggagggtgagatgggggaggtgagatagccctggggggggatgggggaggtgaggcagccctgggggcacaagtgctgtccccacatccatcagagggtggcagggagggactgctacaggggggcagtcctggggagcagctcttcctggggtctcccctggccctcagacctgctctgcccccagccccacagtccatgaaactccccggcccaccccacagaaggccacttaggacagtcacactgtgtgttctcctgtgttacagacgttaacctcgaattccacgactgtaaactgttgagaccactcaggaggccctgggcagcagttaggcccgcaccccaaatcgagcgcgggggaccaagtcctgcctgcgctcccagccagctgggctgccggcggggcggggggcatgtcccagcccccatggagtcctgtgaaccggcagatggaggctctgtggctctgcctttcaaataaataaataaaactgaaaaactaacaaaacaaaaagccgtgcaccagaagccgcagcaggcactagggcaggggtctcatcagagatgggggcggggcggggggcgtgagggcttggccagggcgcgctctgtgacctccgctctccgcggggatcaaacgtttccttgtaagatgcaaactctgcaggctggggtctcccttcccgcatgcgccagctccgaaccccaccacgggtctccccgggcagcggacaagaccccccagcccaccccggcggccggcactcggtgcccctgccccaggagccaggagccggcgcgggccgggccgtgcgggatgggactggcggcctcgtgggaactcggtgctttagatgggtttaacaggggtgcggggagtggaggcccacgcggccgagccccgccaagtcccacccttagggtccgacggcgtcggcggcagagtctctccgctccgcggccctgggaaaccccgggcaggggaccctgggcggccaagcggatcctggggacagggcctggggagggtgggctgggggctcttgggggcgccacgtgcccgggagctggaacagggacacggctcgcgggcttccgcacacctcttcgaggcccgcggtgccccctccccgcgtgcagggcctaacgaggcagaggtgcgctctcagcacgcgggatgctgggcccagggccagcacggcgggggctgtgcggggagaggcggccgcgcagggtcctcgccgcccgctgagccgcagccccgagcccggcagggctctgctgcccccgtgtggccgccggcagccgctccacagcccggggctggactgcggcccaggcgcggcggaaggaggggacggagggcagggcggagggcggaggggacagggcgggcaacagggcgggggcagagccgggcagggtccgggaccaggtggcagttggcggctccctcgaggctcgggcgccccctcgtggcctctctcgtcccctgcactccgtgtccactgttagcgggcggcaggtcccggcccccacccagtttcccggccagcagggagtcccggggctctacatgagggccgtttggccacagcaggacagaggggcttccaacggcaagggtgagaggcgtcggcagaactggggggcgcccctttgtcccccacctgcctgcacccctgccccagcagctccttgtgggaggcgcagttcctcggaacgagggcaggggttccccgctagtgagactgtgggtacagacggggcaaggtcaggctcgggaggggcccggatccctggcaggtgccacctgcgcggctggcgcgggacgcgcgcgggtgaggccgcttgggcgccccctggtggccgcgctgcaccactgcgcgccccggatcggcctcgaggacgcgggggctccgttcggctcgcgccgggcgcctcctttaacgcaacgagccacttccgagggtgcgtggggctcgaggaaggccgttccccaagggacgccgccgaggaggggcctcggccgcctgcacgcgtgctctaagccggaggtccgcgccactagccagagcgcgctgggttcccgctggggtctgcgcctgaagcaagccgcagagagccgcgtcctccccggagccccccagagcggcggtcagcccgaagatcaggccctggaggcccgcgcccggcggagcggctggcgacgcccgcgtgcgcaccctggcggccacgagcgggacaacgcagggcgccccgcgagcgccaggagcggactcggggcaggagcgccggcgcgctctgcctttcaaatgtaaaaaaataataatgatgatgatgaaagcacctgagaatgggccaaggaaagccgcggagccccccggtgccgccaggcgcggccgcagcgccgtccccctgtgcccccggctgaccggtcagttcgggctggcaggggactgggcccgcggcaggagtcccgggaaagaggggacttgcgctgcgatggcccctggggctggaggcggcctgcggggcgcgcggaggacgcaccccacgctccccgcatttggttttgcttccacgtgaatccgggctgctcagctgtgcgtgagggcccagcagcccccatggaccagccccaggaggacgccagggggtggcttcccagcgctcttggcggcgggagaggctgggacccacgcacgctgaggctcccgcaccaggcaggcagtggggcctccagaggggagcagagacgcgggtccctgggccatccgcagggcctgacagaatctgactcccgggactggcactcagtgggcacgggggatccgagcgatgacttcagatatgaagtgatgacttcatccttgatttgaaagagttaacaggggccggtgctgtggcgaagcgtgtaaagccaccacctgcagtgctggcatcccatatgggcaccggttcaagacccggctgctccacttccgatccagctccctgcgatggcctgggaaagtagtagaagatggcccaagtccttgggcccctgcacccacgtgggagacccagaagctcctggctcctggcttcagatcggccgagctcgggctgctgtggccgtttggggagtgaaccagcggatgggagacctctctctctgcctctttgtagctctgccattcaaataaataaataaaatcttaaattaaaaaaaaaaaaaaagaggagcagccaggactcggaccggcaaccatatgggatgctggccctgcaggcaggggtgtaggcttctaccccacagcgccggccccaggcaattttgtgagcattgaaatagttgatgcacgggtaggctagtggcgcagcaggttaagcccagcctgcgatgccagcatcccacacaagcaccgactcaagggagggagacccagatggagctcctggctccaggcttcagcctgcccagccccagctgttgcagccacctggggagccaaccagcggatggaagattctctctctctgtctcctctctcctctcccagtcaagctgccttttggataagtaaataaataaatcttataaaagtcgagctggcaccaggaagagaggaagaggcggctccgtcggagtccagcggggcttggcgtcttgaattctgcaccgtgagaaagtgcggctttggcggcaggagctcccgatcgccctcagaccctgcgtctcagcgagcgggtctcaaagaccctgggtgcatcccgcacgttctacggcaaagtcagctcaggatgtaacgcccaaatctgacctgtgaaacgggtgcccttaatccagcctggggtgtgccggccaagagcgcagcgggaggcggggtgggggggttggtggggggaggggggcagaggggaggcagagggtgttggtggggggaggcgggagggggcaagaagaggcggggggggggtgcgggaggcggcagcgccggcccaggcgcccagggcagtgagctctgcagccgtctgtgccacgcgtgcgtgtggatgtgtgtgcatcgcatgcgttgctgcacatgtgtgtgcgtgtggtgtgcgtgtgcactgtgcactctgttgcgtcgtattgcatggtgcgtgtgtgcacatcacatgtgtgttgtgtgtgctgtgcgcgtgtgatccaccacgtgtacctctgtgcacgggggcgggggcagcgctagtgcccaggtcctctacttccgggggcgggagcatccccgccgcccctgcccccgggtctcctagagccgcgcgctgtgctttagttacggggtggtctcggggctgcgaggatctcctaacggctggccagggcggccgcattgcgtcactcgggttctgacgtcacgctgctttgcattcgagggattttgtgttttccctgctttccacggaataggtgatccttcttcctgccggagtgaaagctgtgcgtgttgccattgttctgagacgcgtttttaatcgcgggctcttagcaccgaatgcatcacaagccgcccgcgcagcctcggcgtctcccgcaccccgcggtgcggcctcctcccggctctgcccctttgtgtggagctcgggcaccctctggtggccacgccgcgacactgctcctgcgccggccaggtgagccttgcgggcggtcctcacattcccgccaccgccctgccagcggccctgcgtcccctctggggccacccttgctctcctctgcgcagctcgcggccccactcacctgtgtgaccccgtctcgccgcagaagaggagcacctcctcctaggaggcgtcccggggccaccctcgggcacgtgccctcacgggactgctgggcgcacctgtacgggcacctggatgcccggctcagccgcagcctccgtcagggccacgacgggacgagacaagcgccggaagccgcgcgattctccccagacggcaccggcaccaggcaggcgccagcaccaggcaggcgggagaaaggtgcaaccacactcagcgatgagcaaaccccttccacgcgtgcatgacgtgtacacgtgctgcaggtgctgctggccgccgggacacctgccggagccccagctcagccacccccagtgccccggctcggctgcccctacacaggcagggcggcgctgggtccccggcacgaagggtgaggctgacggacggcaggtgagcctcacctgatggtttctcccacaactgcatccgcacaagggcactgccatgagggcagcagagaccaagggcaccgcgggagccagagggaccggaggacgcccccggcgggtggggaccccggcccggccctccccccactcagcctctgaacacgccctgtccccgtgcagtgtctgctctcccagtcaagccctcggatcttctgagactccggctgccggcggggggatgggggggacacactgaccacgaagccaggggccttaccctggctctggtaggagcgggcactgatgcagcagtcaagacgcccacacacgtcccacattgggggtcgggccctggctgtgtgtcgagctctcaatttgcactaactcagaccctgggagccgaccggctgggtccctgccacccacgtgggagcccctaattgagttctgggctcctggggcccctggaagtgagccagagaacgtctctggctctgcctttcttcactgcgtgaggtgcagtcagcccctttgctcacaggcggtgatgctgtggacagaaagatcggaccacaggctggagcaccggagccaagctctgggccgagggtgaggctgcagaaccaacgcagccagggccaggaccacgggacagcagacagcgcagggaagtgtgaggtccacgtggagatgtggagactagggcagaagccagaatccagtgacccccagtgatgcccagtgacacccagtgatgccccagagacacccaggaacaccccagtgatgcccagtgatacccctatgatgccccagagacaccccagtgacacccagtggtgcccagtgacgcccagtgatgcccagcaatgccccagtgacccccagtgatgcccagcgatacccagtgacacccagtgacccccagtgatgccctgtgatgcccagtggtgcccagtgacccccagtggtgcccaccaacacccagtgacgcccagtagtgcccagtgatgtccagtggtgcccagcgacacccggtgacacccagtggtgcccagtgacacccagtggtgcccagttgatgcccagtgacccccagtgactgcctttggcccaagcatgtggcccgtgtgcatcctcactcagccccaggtgacgctcaagtgctgtggtcccgccctccacatggaggcgcaggtggagctcctggcccagccccggccgtcgtgggcatttgtggagtgaaccagtggctgggggctcactccctctccctcttaaaaaaatttaaaagcaaattaagtaactagatatgtaaacaataaaacaataatgtcctgggcctgggtgtggcgtagcaggtaaagccaccacctgcagtgctggcatcccatatgggcaccggttcaagtcccggctgctccatttcagatccagctccctgctatggcctgggcaagcagtagaagacggcccaagtccttgggcccctgcacatgtgtgggagacctagaagaagttcctgggtcctggcttcagatcagcatagctccagctgttgtggccaattggagagtgaaccagtggatagaagattctctctctctctctctctctgcctctgcctctcaaataaataatctttttttttttttgacagtcagagtggacagagagagagagagagacagagaaaaaggtcttcctttgctgttggttcaccctccagtggcctccgcggccggcgcgctgcagccggtgcaccacgctgatccgatggcaggagccaggtgcttctcctggtctcccatgtgggtgcagggcccaagcacttgggccatcctccactgcactccctggccacagcagagagctgacctggaagaggggcaaccgggacagaatccagcgccccgaccgggactagaacccggtgtgccggcgccgcaaggcggaggattagcctagtgagccgcggcgccggcctcaaataaataatctttaaaaatagtgatccaagcttctccctatagtgagtcgtatta

SEQ ID NO: 104 - DNA, 16658 bp, Oryctolagus cuniculus
  misc_feature (3112)...(3121): N=A, T, G, C
ggggggggggggggtgctgacacgcagcccccagcccccggggcagcagctgccatcagcagcaccatcttggaagacccccagggcgctgggcaggccccccagggcagacaagaacacgttgccaggaggggtctcagccagtgtggacgggacccccccccgggacccgggtcacaggggaggcagcagctgttggtccttggggctcagggctccagggtttggggtcctggggtgcactcagcactggtcctgccagggagtctgcagccctgaacgtgggcagatgtggccaaccttggcgggggctgggaaggcagggacagcaggccctggggaggcactcgagggggtagtgtgtgcctggtggtccaggcaggaggaccgcggagtctgagggagcccaggtggggatcccaacccggggctggggacaagcaattcgtgttccagaaagatccctcaaacatggggggagggggcttcttactctgaaaactggaaagtgaacaggcacaggcagcctcactccgcctctgtccccctctccccccttctctctctgtccccccccctccctctctctctgtccccccctctctccctctctctctgtcccccctctctgtgtccccctctccctgtccctctctctctgtcactctctctcaatctctctctgtccccctccgtgtccatctctatctctctatccctctctctttctctttgtcttccccctctgcctctctctttctccatctctttgtctctgtctctctctgtccctccctccctctctcctctctccctctccccgtgtgtgtgtgtgtgtgtgtgcgcacgtgtgtgtgtgtgtctgtccctctctctctctctctctctgcacctgggtccctccctgtcctgaacttgtgggtaaggagacgccaccatcagcctcacccgctcctgtgaggtcccgacaatcacctccttctagaaggttcccagccaacacgtgaaggggcgtgaaggagacaggagacccccaccttgcagccccttgagagataagacagggcaccagagccttcagccaggccccaccaggggctgggccccggcaaagccccaccactgcccatgggcacggccgggagcctggtgggcagtgccctcgggggctccagagaggggcagcggctcagcctgcggggccagggtggggcccgagtgtcagtgtgatttgggcgaggctgcgtcgtccccactgaggatggggagttctgggggactgggtgacccgggaggcctgactgagagggacagagacttgccaaccttggcgggtggcacgccgagggtcacgggggcccccgtggtgtctgggagagcgggggagctgggtgtaggctgagctgtgggtgggccccgtggcccctgggcgcctccatcctgtcttgtccccgcgtcacccttcaggatggacccctggcccccacggcacgctgcccagggtgtgggcccgggtcttgggccccctccccacgccccgtctggtgcaggtcagagggcctcggggcgtgagcggccagtggggggagctgcccgaggacaggcaggagatggccaggctccaggtctctgtcctcaaagggccaacgctctcccgcctccactctgcccaggaccctgggccccacccaaaacgctctccacctcctgccgccccgtgccttctccggacggcagcccctgctcctcggctcagttgaggcaaagccgaggcccccacctcgagcccccgcgggtccagcagcctgcgccctcctgtcccacccgtcttccctcctctctgctgccgctgcactggggtgggaggagcctcactcgagccccttcccacagatcgcggccccccaggtccctccaggacactggtcctgtggcctgcagcctccctcccctcctcagaccacgtcccctgtgtgtgccctctgtgactgtccgggctgcccagcccctcctgaggggcccacgtcagcctcaggcctgagcccccgggctggcatccagcaccccagggtcccaggccctcctgctctcccgtccccacctgccctgccccgtgtttggggccccatgtgggtccccagctgcctgcctggccacccagtggttgggacagagtgggagccaacgggtgtccagccaccccgggggcctgcctggcaggtgggggtggctccctgtgctgctctgcccccagccgcagaccaaccccccagggtccaaccagcgctggcttggcggcactggctgccagcccacctgcccctttgtcctgtgccgtcagagctcacagcccaccctgagccaggccctgggtgggtgctgccctcagggcacatgtgccctgctcacagatgggatccccagacaggacgtgggggccacagcaggagcagtgggacctgttactcagccctgagcctcagggtgactctgagtccaagggagggaggccgtgggtgtgagcacgtgcgtgtaagtgtgggagtgagagtgtgagcgtgcaagggaaagtatgtgagtgggtatgtcagagtgaggtgggcatgcgtgtgcgtgggggtgcatgagtgtgagcacgtgagtgactgtgagtgagggatggtgagagagggtgtttgtgtgaaatgttggtaaaagtgatgagtgtgcgagtgttgagagtgtgtgtatgagtgtgggtgtgagtgactgttgagagtgagagagtgggtgtgagtgtgtgggagttaatacagctgtgagtgtgcctgtgagggctaggagtgagtgggggtctgagtgtgtgttgagagtgagtgtgagtgtgtgattgttgagaatgagcggtggtgtgtgagtgtgtgcatacgagtgtgcaaagcatgggtgtgcgatgtgcttcatgaggcttctgctcttgtcactgccagttttttcccctgtattgatggctcttgactcttttactcttaaaaataacgtggtttatttatttatttatttatttatttatttatttatttattatttgagaggcagaaagtgagtagagagtcgagagagcagaggaaannnnnnnnnnggacacactcagacacacacagacaaacacacagggacacactcagacacacacagggacacagagagacacatatagggacacacacagacacacacacagacacacacagggacacaaacatagggacatgcacacagacacacacatagacacagagagacacacagggacacagagagacacacagggacacactcagagacacacacagagacacacacacagggacacatgcacagagacacacagagacacacagggacacacacagacaacagggacacactcagacacacacagggacacacagacacacacagggacacagggacacactcagacacacacagaaagacacacacagggacacacacagaaagacacacagagggacacacacagagggacacacagggacacacacacagagacacacagagggagacacacacagacacatgcagatacacaccacctacacaaccaagtcacacacacatatgaatacacacatatatgggcacacacagagacatacccacatgctcagacacacacagagacacagagattcacacacacacatatatggacacacacagacacacacacatatggatacacacagatactcagacacacagatacacatacacatggaaacacacagacacacacctacaatctcagacacacagagacagagacacacacagacaccgacaggctcagacacacacaatcacacacatacacagaaacaaaaagaaaaacactcacagattcgcacacactcagacacacacaagtgaagatacactcacactcacacacatgcagatacagacacacccagatacacctcaacacactctgatacacagatacactcacacacactcggataaacacacagacacacacatatgtgttcacacactcagacactcaggccccacagccccagcagtgccctcccaactgccctgcccttcagccctggccctgcgccttccaagtagccagggggcctgggcagagtggacagagacaagtctggggctggggacggtgaagtcaggcctggaaggatgagaggggtttgcccgcccacccgggagcccccgcacacctgcacacacaccacacgcagcttccacttgtggctcacgctcatgctcacacgcacactcctgcacacgcgcgcgtggtgtggctgggccgggctttggcgtgtggggtcagggagagctggcagagggagtgcctcggccattctgggccagtcgggctgcaggcgggggtccaggcacagggcagcggcacctcagtaccatgagggcagctcagactggcatcgtgtggggtcaccatagcattgcacacgtgtgttcctggcatgtcgcatgtgcgcatgtgagggactcctagggtggtctccccagggcgttggcacacgacgcctgggcccctagctcagggacacagtggggccggaagcttctgtctactgaccagccctgggccggctctgttgtgaacactaggcagagccaggccgcactcagaattggcatctggaccacccgggggcccctcaaaacagctccacacctgaccagggtgggctgtacacccggggggcccagccgggaccctcatgccggatgcctggagcagagccccggctcccctcccccaccacagcccagtctgaaaaacaagacccggtgtgggcacccagctgtggctcccacccacgctgtgcaccgggacaaacaagcacttgcaaatgtttctaaaatcgggaagtgcgggaaccacagagcaggtggggcccggggtggaaagccccactcacccctgagaccgaaactggagaagccaggactgtgggggatttgcattgggggagggggcaagccaggctgcttgggaggactgctaaccctcccagcccccaccctgccacctcagctagccaggcctgtgctgtggcgtggccaggcccagagtgaccagagccaccagaccccaggagcgcttcccagagaagaaacctcgtgtaagggcacggggggcttccctgcccaggcagaacgcggggccagccggccgcccctgggggaaggggctcacattcaggcccttgacaacctgctctgtgtccaagctttgtccctgctgtgcccacactggaccatcccagccagcttcaaggcacggcccctcgggcacgtccacccccagcctcaggattccctgggcctcgcaacagctgcccccgaccagacctgcctgagcccagccccgtgcgccgggggacacagaggcctgtgcgacccaccccactccggccctcggcgcaccagccgggtccctagcgctctggggcagaggcaggaagggtctgtgcgggcatccctccccgccgagccgagcctgcagggagccctgggggccggaggaaaaggggctcaaagctcagccactgtggccgagagagcggtcaggcagcatccagccggcacgggtcccccagaacagtcacactgaccacacgcacagacacaccagagatgcccagagagacaggcagacgcactcagagatacactgaccacacgcgcagactcacacagggccagggccacacacggagacacacgcagacacacacagagccacacagagagacacatacacatgcagagacacacaaccacacacacacacagagatacacagacacacacaggaacagacagggccacacacagagacacatacacacacagagacaaacacagacacatacagagccacacagagagacacacacacacagacacaaaggaacagagccacacacggagacacacgcagacacacacagaaccacacagacacacgcagacacacacaggaacagacagaaccacacacagacacgcaaacacacacactcacatgcagaggcacacacagacacatgcagacacacacagagacaaacacacacacactcacatgcagaggcacacacagacacatgcagacacacacagagacaaacacacacacactcacatgcagaggcacacacagacacatgcagacacacacagagacaaacacacacactcacatgcagaggcacacacagacacatgcagacacacacagagacaaacacacacactcacatgcagaggcacacacagacacatgcagacacacacagagacaaacacacacacactcatatgcagaggcacacacagacacatgcagacacacacagagacaaacacacacacactcacatgcagaggcacacacagacacatgcagacacacagagacaaacacacacacatacacacatgcagaggcacacacagacacatgcagacacacagagagacacacacacacacactcacatgcagaggcacacacagacacatgcagacacacacacagagacaaacacacacacatacacacatgcagaggcacacacagacacatgcagacacacaaacacacacacactcacatgcagaggcacacacagacacatgcagacacacacacagacacccagacacagacactcagagactcacacaggaacagacacggccacatgctcaatgcagccgtactcgatcagggctcccaggcacacgccaaccccggacacacacaggaaggtggggtgggctgggagggactccgagaccccaggcctcttctcaggctcccctgggtgtggcttcattctggcgacaggggtaccccaggtctgcagtccacagcgggaggctcacctcacaccggcacacccagcactgcccaggctccacaccacagggagggcacactcacactcacacacccacccacacactcgcatgcccactcacactcacattcacacacactcacatacccactcacacacacactcgcatgcccgctcacactcacactcacactcacatacccactcacactcacacacacccactcacacacacacacacacatgcccactcacacacacactcacatgcccactcacactcacattcacacacacactcacatacccactcacacacacacacactcacatacccactcacacacacactcacatacccactcacacacacacacacactcacatacccactcacactcacgcacacacatacccactcacactcacgcacacacatacccactcacactcacacacactcacatacccactcacacacacacactcgcatgcccgctcacactcacattcaaatgcccactcacactcacatgcccactcacatgtgcactcatacacccactcacactcatattcacacacacactcacacactcacactcacacacccactcacactcacacactcatatgcccattcacactcacgtgcccactcacactcacactcacgtgcccactcatactcgcatgcccactcacactcacactcgcattcacacacctactcacacatccactcacacttgcattcaaatgcccactcacactcacatttaaatgcacactcacacacccacttgcactcacatgtccactcacacacactcacacacctactcacatgcccactcacacactcatactcgcacatccacttacatgcccactcacacacacattcacacactcacatacacacactcacactcacacacacacattcacacactcacactcacacatactcacactcacatacacactcacactcacatacacactcacacactcacactcacccattcacactcacactcacatactcacacgcccactgtcagccacacacacagcttcggcagctgctggtgagtccaacgcctgagctcctccaccctgggccgagcacgtggacccggtgccgcctcgccatgagcatggctgggagccctgccctcccacccccatcctgcacctccgtgtccccacactgccccctcccactcccacctgcccctctgggggtcactccagaccccacacctggccacagcccacagtgcaccgggagactgctgcgtggccacctgtgcccagggcctcctgcggggagcacgggcaggcgggtctgctgtgtggtccagggtccagggaggacagcaggcacaaggtgaccactgccgctctcatcctctgccgagcacctcgcctggaaacccagtcacagccaggcctgtgtctcgaccccagcactccccccaggcccgctgccagccgagggcagagcaggtgcgggcagtggctgagcccccacatgcagccccgtgggttaggtgaccccatgaagcctgaagccccttgggggaagaggtcaatgtggggccgccagttcttgaggctgggccagccatggaggccggcacctgaaacgtccctccaggctgcggcagtaggtggtgtcacagtgaaaagcagccggccctgtctctgggagggaaaggaaagtccattctgtgagggcagccccgtgtcctgtcgggcgcggcatgaggacggggtgtgaaacgcttgatgagcttatgacccaagagaaagagcgagccagggtcctgggggggaagggggggaccaggaatcccagtgaggcagccctgggggtcaggggaggtgaggcagccctggaggtcaggggaggtgaggcctcacatgcagacacacacagagacacccagccctggggggagatggggggaggtgagatagccctgggggtgagatgggggaggtgagatagccctggggtgagatgggggaggtgagatagccctgggggtcagggaggtgaggcagccctggaggtcaggggaggtgaggcagccctggggggagatggggggaggtgagatagccctggggggtgagatggggggaggtgagatagcccttgggggtgaggtgagatgggggaggtgaggcagccctgggggggtgagatagccctggggggtgagatgggggaggtgagatagcccttgggggtgaggtgagatggggggaggtgagatagccctggggggtgaggtgagatgggggaggtgagatagccctggagggtgagatgggggaggtgagatagccctggggggggggggatgggggaggtgagatagccctggggggtgaggtgagatgggggaggtgagatagccctggggggtgaggtgagatgggggaggtgagatagccctggagggtgagatgggggaggtgagatagccctggggggggatgggggaggtgaggcagccctgggggcacaagtgctgtccccacatccatcagagggtggcagggagggactgctacaggggggcagtcctggggagcagctcttcctggggtctcccctggccctcagacctgctctgcccccagccccacagtccatgaaactccccggcccaccccacagaaggccacttaggacagtcacactgtgtgttctcctgtgttacagacgttaacctcgaattccacgactgtaaactgttgagaccactcaggaggccctgggcagcagttaggcccgcaccccaaatcgagcgcgggggaccaagtcctgcctgcgctcccagccagctgggctgccggcggggcggggggcatgtcccagcccccatggagtcctgtgaaccggcagatggaggctctgtggctctgcctttcaaataaataaataaaactgaaaaactaacaaaacaaaaagccgtgcaccagaagccgcagcaggcactagggcaggggtctcatcagagatgggggcggggcggggggcgtgagggcttggccagggcgcgctctgtgacctccgctctccgcggggatcaaacgtttccttgtaagatgcaaactctgcaggctggggtctcccttcccgcatgcgccagctccgaaccccaccacgggtctccccgggcagcggacaagaccccccagcccaccccggcggccggcactcggtgcccctgccccaggagccaggagccggcgcgggccgggccgtgcgggatgggactggcggcctcgtgggaactcggtgctttagatgggtttaacaggggtgcggggagtggaggcccacgcggccgagccccgccaagtcccacccttagggtccgacggcgtcggcggcagagtctctccgctccgcggccctgggaaaccccgggcaggggaccctgggcggccaagcggatcctggggacagggcctggggagggtgggctgggggctcttgggggcgccacgtgcccgggagctggaacagggacacggctcgcgggcttccgcacacctcttcgaggcccgcggtgccccctccccgcgtgcagggcctaacgaggcagaggtgcgctctcagcacgcgggatgctgggcccagggccagcacggcgggggctgtgcggggagaggcggccgcgcagggtcctcgccgcccgctgagccgcagccccgagcccggcagggctctgctgcccccgtgtggccgccggcagccgctccacagcccggggctggactgcggcccaggcgcggcggaaggaggggacggagggcagggcggagggcggaggggacagggcgggcaacagggcgggggcagagccgggcagggtccgggaccaggtggcagttggcggctccctcgaggctcgggcgccccctcgtggcctctctcgtcccctgcactccgtgtccactgttagcgggcggcaggtcccggcccccacccagtttcccggccagcagggagtcccggggctctacatgagggccgtttggccacagcaggacagaggggcttccaacggcaagggtgagaggcgtcggcagaactggggggcgcccctttgtcccccacctgcctgcacccctgccccagcagctccttgtgggaggcgcagttcctcggaacgagggcaggggttccccgctagtgagactgtgggtacagacggggcaaggtcaggctcgggaggggcccggatccctggcaggtgccacctgcgcggctggcgcgggacgcgcgcgggtgaggccgcttgggcgccccctggtggccgcgctgcaccactgcgcgccccggatcggcctcgaggacgcgggggctccgttcggctcgcgccgggcgcctcctttaacgcaacgagccacttccgagggtgcgtggggctcgaggaaggccgttccccaagggacgccgccgaggaggggcctcggccgcctgcacgcgtgctctaagccggaggtccgcgccactagccagagcgcgctgggttcccgctggggtctgcgcctgaagcaagccgcagagagccgcgtcctccccggagccccccagagcggcggtcagcccgaagatcaggccctggaggcccgcgcccggcggagcggctggcgacgcccgcgtgcgcaccctggcggccacgagcgggacaacgcagggcgccccgcgagcgccaggagcggactcggggcaggagcgccggcgcgctctgcctttcaaatgtaaaaaaataataatgatgatgatgaaagcacctgagaatgggccaaggaaagccgcggagccccccggtgccgccaggcgcggccgcagcgccgtccccctgtgcccccggctgaccggtcagttcgggctggcaggggactgggcccgcggcaggagtcccgggaaagaggggacttgcgctgcgatggcccctggggctggaggcggcctgcggggcgcgcggaggacgcaccccacgctccccgcatttggttttgcttccacgtgaatccgggctgctcagctgtgcgtgagggcccagcagcccccatggaccagccccaggaggacgccagggggtggcttcccagcgctcttggcggcgggagaggctgggacccacgcacgctgaggctcccgcaccaggcaggcagtggggcctccagaggggagcagagacgcgggtccctgggccatccgcagggcctgacagaatctgactcccgggactggcactcagtgggcacgggggatccgagcgatgacttcagatatgaagtgatgacttcatccttgatttgaaagagttaacaggggccggtgctgtggcgaagcgtgtaaagccaccacctgcagtgctggcatcccatatgggcaccggttcaagacccggctgctccacttccgatccagctccctgcgatggcctgggaaagtagtagaagatggcccaagtccttgggcccctgcacccacgtgggagacccagaagctcctggctcctggcttcagatcggccgagctcgggctgctgtggccgtttggggagtgaaccagcggatgggagacctctctctctgcctctttgtagctctgccattcaaataaataaataaaatcttaaattaaaaaaaaaaaaaaagaggagcagccaggactcggaccggcaaccatatgggatgctggccctgcaggcaggggtgtaggcttctaccccacagcgccggccccaggcaattttgtgagcattgaaatagttgatgcacgggtaggctagtggcgcagcaggttaagcccagcctgcgatgccagcatcccacacaagcaccgactcaagggagggagacccagatggagctcctggctccaggcttcagcctgcccagccccagctgttgcagccacctggggagccaaccagcggatggaagattctctctctctgtctcctctctcctctcccagtcaagctgccttttggataagtaaataaataaatcttataaaagtcgagctggcaccaggaagagaggaagaggcggctccgtcggagtccagcggggcttggcgtcttgaattctgcaccgtgagaaagtgcggctttggcggcaggagctcccgatcgccctcagaccctgcgtctcagcgagcgggtctcaaagaccctgggtgcatcccgcacgttctacggcaaagtcagctcaggatgtaacgcccaaatctgacctgtgaaacgggtgcccttaatccagcctggggtgtgccggccaagagcgcagcgggaggcggggtgggggggttggtggggggaggggggcagaggggaggcagagggtgttggtggggggaggcgggagggggcaagaagaggcggggggggggtgcgggaggcggcagcgccggcccaggcgcccagggcagtgagctctgcagccgtctgtgccacgcgtgcgtgtggatgtgtgtgcatcgcatgcgttgctgcacatgtgtgtgcgtgtggtgtgcgtgtgcactgtgcactctgttgcgtcgtattgcatggtgcgtgtgtgcacatcacatgtgtgttgtgtgtgctgtgcgcgtgtgatccaccacgtgtacctctgtgcacgggggcgggggcagcgctagtgcccaggtcctctacttccgggggcgggagcatccccgccgcccctgcccccgggtctcctagagccgcgcgctgtgctttagttacggggtggtctcggggctgcgaggatctcctaacggctggccagggcggccgcattgcgtcactcgggttctgacgtcacgctgctttgcattcgagggattttgtgttttccctgctttccacggaataggtgatccttcttcctgccggagtgaaagctgtgcgtgttgccattgttctgagacgcgtttttaatcgcgggctcttagcaccgaatgcatcacaagccgcccgcgcagcctcggcgtctcccgcaccccgcggtgcggcctcctcccggctctgcccctttgtgtggagctcgggcaccctctggtggccacgccgcgacactgctcctgcgccggccaggtgagccttgcgggcggtcctcacattcccgccaccgccctgccagcggccctgcgtcccctctggggccacccttgctctcctctgcgcagctcgcggccccactcacctgtgtgaccccgtctcgccgcagaagaggagcacctcctcctaggaggcgtcccggggccaccctcgggcacgtgccctcacgggactgctgggcgcacctgtacgggcacctggatgcccggctcagccgcagcctccgtcagggccacgacgggacgagacaagcgccggaagccgcgcgattctccccagacggcaccggcaccaggcaggcgccagcaccaggcaggcgggagaaaggtgcaaccacactcagcgatgagcaaaccccttccacgcgtgcatgacgtgtacacgtgctgcaggtgctgctggccgccgggacacctgccggagccccagctcagccacccccagtgccccggctcggctgcccctacacaggcagggcggcgctgggtccccggcacgaagggtgaggctgacggacggcaggtgagcctcacctgatggtttctcccacaactgcatccgcacaagggcactgccatgagggcagcagagaccaagggcaccgcgggagccagagggaccggaggacgcccccggcgggtggggaccccggcccggccctccccccactcagcctctgaacacgccctgtccccgtgcagtgtctgctctcccagtcaagccctcggatcttctgagactccggctgccggcggggggatgggggggacacactgaccacgaagccaggggccttaccctggctctggtaggagcgggcactgatgcagcagtcaagacgcccacacacgtcccacattgggggtcgggccctggctgtgtgtcgagctctcaatttgcactaactcagaccctgggagccgaccggctgggtccctgccacccacgtgggagcccctaattgagttctgggctcctggggcccctggaagtgagccagagaacgtctctggctctgcctttcttcactgcgtgaggtgcagtcagcccctttgctcacaggcggtgatgctgtggacagaaagatcggaccacaggctggagcaccggagccaagctctgggccgagggtgaggctgcagaaccaacgcagccagggccaggaccacgggacagcagacagcgcagggaagtgtgaggtccacgtggagatgtggagactagggcagaagccagaatccagtgacccccagtgatgcccagtgacacccagtgatgccccagagacacccaggaacaccccagtgatgcccagtgatacccctatgatgccccagagacaccccagtgacacccagtggtgcccagtgacgcccagtgatgcccagcaatgccccagtgacccccagtgatgcccagcgatacccagtgacacccagtgacccccagtgatgccctgtgatgcccagtggtgcccagtgacccccagtggtgcccaccaacacccagtgacgcccagtagtgcccagtgatgtccagtggtgcccagcgacacccggtgacacccagtggtgcccagtgacacccagtggtgcccagttgatgcccagtgacccccagtgactgcctttggcccaagcatgtggcccgtgtgcatcctcactcagccccaggtgacgctcaagtgctgtggtcccgccctccacatggaggcgcaggtggagctcctggcccagccccggccgtcgtgggcatttgtggagtgaaccagtggctgggggctcactccctctccctcttaaaaaaatttaaaagcaaattaagtaactagatatgtaaacaataaaacaataatgtcctgggcctgggtgtggcgtagcaggtaaagccaccacctgcagtgctggcatcccatatgggcaccggttcaagtcccggctgctccatttcagatccagctccctgctatggcctgggcaagcagtagaagacggcccaagtccttgggcccctgcacatgtgtgggagacctagaagaagttcctgggtcctggcttcagatcagcatagctccagctgttgtggccaattggagagtgaaccagtggatagaagattctctctctctctctctctctgcctctgcctctcaaataaataatctttttttttttttgacagtcagagtggacagagagagagagagagacagagaaaaaggtcttcctttgctgttggttcaccctccagtggcctccgcggccggcgcgctgcagccggtgcaccacgctgatccgatggcaggagccaggtgcttctcctggtctcccatgtgggtgcagggcccaagcacttgggccatcctccactgcactccctggccacagcagagagctgacctggaagaggggcaaccgggacagaatccagcgccccgaccgggactagaacccggtgtgccggcgccgcaaggcggaggattagcctagtgagccgcggcgccggcctcaaataaataatctttaaaaatagtgatccaagcttctccctatagtgagtcgtatta

SEQ ID NO: 105 - DNA, 124285 bp, Oryctolagus cuniculus
gaattcagagctcaatgagttgccttgttcagagctctattttcacttgaaaatcaactgagaaaaactatggttaggagacttgggtatcggcagacaaacaaaacggacctcatactccaaagaaaactgacagtatttgtggtaagattcagggtttcaggtgaaagttagaatactggaaaactttgatctgccagtacaagcttgataacttcccaggacttaagatttttctggtgagttcagaggtaataacaacagagctgatagtcgataaagaaatacatcaacatttggaagatctatgggacctagcaggtcaatattttctaaatgatgttatgaatcacaaagcataaaaggcaaatcggaacaatggatgctaatgcaactaggtagaaaatgtaaactgtataattttggattccatggtgtgattaacctttacaaatcttccacttgtttccgtgtagtaccaaatacagtgaccacgtcccagaccagcagaggcagcagctagagcagtctgtgccctccacccgcctcagggtctcttcccccttccctcttcctcctcttctgtctccccctttcctctcccttgtcttcctgtccccctgttgtccaccccccccccacaggcctcctgcacttcctcttcacccctactccccctttcccctcagccacctctcacgcctgcagttttggcttcaccccatcagtgaccacagacttgaccgttcaaagtccagctcccaagaacatggcacgacatggacaccggtgtgactgaaggtggattacatgtcactctcaccatccggctacttatgcatggcaaacaaagtgtcagtaccatcagaaagacagggagaaaaaaaaaaaagaaaaaaaaaaaaaagaaagacagggagaatctgacaagaagatgcatgaggagagtggtgcacgtattaacatctcaaaagggaactgtcctgagagaatgatcactttggctggacccactaatgccatcttcaacacatttgctatgatcattgacaaacaggaagaggacatcagcagctctatgaccaatagcatagctgcctgtagacctccagttaccctgaggctggtggttcccgctagtcagtgtgccttactcactggaaaaggtggttgcaagatcaaagaaatacgagaggggccggggctgtggcgcagcgggtaaaactgctgcctgcagtgccggcatcccatataggccccggttccagacccagctgctccacttccaatccagctctctgctatggcctgggagagcagcagaagatgaccaagtccttgggcccctgcaaccacatgggaagacccagaagaagcttctggctcttggcttcagattggtgcagctctggtcattgttgccaatttgggagtgaactagtggatggaagatctctctctctctctctctctctctctgcctctctctatgtaactctgactttcaaataaacaaatacattaaaaaaaaaaaaaaggaaatacgagagtacaggggctcaggtgtaggggatatgttccttaactcaactgagcaggccatcactattgctggcatcccgccttccatcactgagtgtgtcaaacaaatccatgtggtcatgttggagtacccccaaagggtgtgaccatcctgtactggcccaagccgtccagttcttcggtcatctttgcaggtggtcaggacaggtacaacataggcagcgagctttccccacaccatccagtccatgtgactcaaccctgacgtggagggaccacctttagaggcctataccattcaaggacagtatgccattacacagccagatttgaccaaggtgcaccagttggcaatgcaacagtttcattttccgttgatacatggcaatattggattcagtggcattgaatccagctctccagaggtgaaagagtattgggcaggtctggatgcatctgcctggactactcatgaactcaccattccaaatgatttgattggctgcataattgggcattaaagagccaaaaaaaaaaaaaaaatgaggtcagatgtctggggcgcacatcaaaattacaaacctagaagaaggatctactgataacaagttaccatcaccagatctgttgccagcattagcctggctcaatacttaatcaatgtcaggttttccttggagacaggtggcatggggagcagctagaccactgcagactcacccataatccctttctgctgttcaccacccataattcatctgtgtagtttctgaacagtcagctatccaggttttaagtagtctgtaaatttttagtttctacacacttcatcatccacttgtgattttttaattaaaagtgttttaatttctttctctattcaagctgttaatgctgagatccatatttagttttataagcttctcatgttttttttcttttgggtttatttttggctcatgaatttttctgtttgtcatggaaatgtaaatgtggaatattaattcatttcagtttagttccataatgtcagaaattttcaaaaaaattaaaagatggactggagctttttctttgtgaacagaaaaaaaaaaaactaacaaaaaaacaacaaccacaattatttgaacagactactaaaatgctcatatccttcccttctctaactatatacatatgtggctggagttcctcctccatataatttaaccaaaacaacaatgcaaaaatttaatgaagaatcagatttaaaaacccaattgtcggggcccacactgtggcgcagtgggttaaagccccagcctgcagcgctggcatcccatatgggcgctggttcaagtcccggctgctcctcttcatatccagctctctgccacggcctgggaaagcagaagatggcccaactccttaggcccctgcacctgcgtgggagctcctggttcctggctttggatcagctcagctctggacgttgtggtcatttggggagcgaaccagcagatggaagaccactctccctctctaactctctttcttttttttttttttttttttttttttttttcatgcatctgttggtcattttgaatttcatttattcccttttcttttttttttttttatttttatttttattttttattttttgacaggcagagtggacagtgagagagagagacagagagaaaggtcttccttttgctgttggttcaccctccaatggccgccgcggccggcgcgctgcggccggcgcaccgcgctgatccgatggcaggagccaggagccaggtgcttttcctggtctcccatggggtgcagggcccaagcacctgggccatcctccactgcactccctggccacagcagagagctggcctggaagaggggcaaccgggacagaatccggcgccccaaccgggactagaacccggtgtgccggcgccgctaggcggaggattagcccagtgagccgcggcgccggccttaactctctttcaaatagataaaataattctttaaaaaaaaattgtcttctagtaaactaggaattaaaagagatttacaaagattctgtcccggttgcccctcttccaggccagctctctgctgtggccagggaggatggcccaggtgcttgggccctgcaccccatgggagaccaggaaaagcacctggctcctggctcctgccatcggatcagtgcggtgcgccggccgcagcgcgccggctgtggcggccattggagggtgaaccaacggcaaaggaaaacctttctatctgtctctctctctcactgtccactctgcctgtccaaaaaaaaaaaaaaaagagatttacaaaaatgtgaaacagtgccacttttctcattacattttcttgtgttggaaaatgtagttattttacatatgaatacatcatttatgttaactgtgcaatgggctttttaatctctctaatcaattaatgtaaaagtcttttgaaaatccattttaatttttaatctaagataaatatcacccaactgggaaaaagctctttggagccctcaattttttcgagagtataaaagggttttgagaccagagagtgtgaagcccgccgtgctacatgaattgcccagcttgattataagagacacatacaagatggggaaacaggctcccagataggcagaaggtggctcagtaagcaagtctgggcttgatcccagctttatcagacattgggcctgtaactttaagcaagtaatgttggagcttcagttgtctcttctacaaaacggaaccaagacaccaacttcaggaggattattaatgagaattacaccatgtataaggctcatcaagtacacattcacgttgcaatgctgtaggaacaacgttgtgtgctctcaacaaacggccccaagaacttggggcagcagtcaaatcaagaaaagctatcatgttttcatccctggttcaatgcctttattttttctctaaagtagaaaattaaaatctagataatgaaaagatgtctcaggtttcttttcctacatggaaaaatggccaatgcgcttttcattggttgctataaaggtgcaccgtgaacttttggaatatacttgcaattcaacatttcaaactattctatccaaaggatctaggtttgggagtgggtgggaaggaagacgcttaaaatgagagatccctactaaaccacagaaaatagtaacaactagggacaggaaaaaaaaaaagctgaactgtagattaaaactcacatagctaatgtcacttatttttaagaaaacctttgagtatgactagctacttatcacttaaacacacgcaatagcacttcagttattacagctatttgcattctactatgtgaaaccatgcaacttttcccttggtttttgtaaacgtttccgtttgcacacacacacatgcttggcaccactacaacacactgtaacattaccttagatgtaagcagcttacaatcttctcattttgctgatcatcgtttatgtctagtttaaaaataaagcaaaacgtgcatacccaagcataatcccagcagaacacaaatgaacacgtttagctggtaccatacctaactcaaaattttaatgtaatctacaaccaagttgaattcccagtagaatagaatgtcattcttctcaaatgatattttcagtatactctctgataggaggtactttagtggggtactttgaaagtctaatcagggctcagtataccaggaatgcagaaattaggcccctgcctgggtgcaccagcacagggctccagttggccttgctggacagcatagggaagtctgtcatcgcagatgggtcaccagtagctaccttccatcagaagttccatcaccgcttctcaggtcatttccaagcccctcatgttagatttctttttcaaatttaattctagccaggaagctttttaaagggaaagactgatggcagaaaaatgactactctagggagtgtcctatgggaccagtttggtgtggccaagggctgacagcattctggaaaggaggtgactgcttcaacactagcagtcacaactcaagaaatggactgactttaacagaagagtcaagctccaggaaaggcgagacttactccatcaaggagtcgaggtggaagtgtgacacagtggttaagtagatccttgagggggcccatgtaggagggcctggtttgagttccagctccatgcctccagctacccgctaacacagtccccagggggtagcagatgacggctcacgtacttgggaccttgccacccacacaggacacacagagttctgggctcctggcttcaatctggcctggccctggctgtcatgggcatttggggaatgaaccagcagatgaaagatctctgtctgtctctgccttccaaataaaatgaacaaaacacacagctgcaagcaaagatttaatccttctgtcccgccccgacctcatcaaggtagacagtgtcctcattttattgattaggacattgaagctctgaggagctaagtcacgtgttcacttgacgtcacgtgccagagtagttttggaagcaaagctcgttcctctctaccattctagatctcagaattactaagcacaatttcctgtttttttttttttttacaaataatcagatttatctagaattatattccaggaaatttcagatgaattatgcttacaactaggatgtaccattgagggaaaatgtagggaatattaatgtatgagattttatggcatggatttctaacaagtaaaacacaatgaagttttcatttctatttgtctttttttttttttaaagatttatctatttatttgaaagtcagagttacagagagaggagaggcagagagagagaaagaggtcttccatccgatggttcactcccagatggctgcaacagctgggactagaaccggcactcatatgggatgccggcgcttcaagccagggcgttaacccgccgagccacagcgccggcccccatttctatttgtcttatttctcctagggggccttgtgaaaataagaataagaaatgattgtgttatacctcaggtactgcgctatactgatacaacagctatcattcctcagttactaatttatatgatttactcagtaaatgctcaaaataatcctaagaaaaaggtgctattatgcatgctatttcatagggggggattatagaatagaaaagttattatttgtcccaaggggacacagcttgttacaggcaagcagaactgaaacccagacactgggtcctgagaccaagctttatatgcaaatacatattattaacatcagcaattccgcatcatgttccccagtcaacgtttaagagcaaattcttacctctggtttgctgaggctggatgaaaccaaggcaccagatcccacatctaaatcccattgctttttgccatgattctcaggatccaaggcagcaattcttccatctaaagtgctgataattactaatgatctgtaagttgagaaatgaaaaggacaggattaggggtgcacctttggtacagtgcttaagtggatacctgggacacttgcaatcaatcctggttgagtcccagctcctccacttccaaccctatccctgctaatgtgcacaatgggaggcaacagatgatggcccaagtgccacccacgtgggagacccagattgcattccaggctcctggctttgacccggcccagccctggtttgttgcaggcatatggggagtgaagtatggaaaatcaccacctctaccttccagataaaatgaaaacaaaaattcaggaaaaaagtcaaaataggaaacttttaaaatatgaataaaacaaaattgaaaaacttcctaagatactgggtacaatattccatacactccagagaacagcagccgctgccaggcctctactgctaggagagacgggagggggaggcaccttccccacgaaaggtacagtctggccactgctgtttttagagcaggacggtttcaatacgccccttttctgtttatgccacttcctggtcgtctccatgccctgcacggtcctcttctaccctccccgcctcctgaaagcctcccctgaaatatgggcttcccgaacattcacggagcttcttgcccccacagaaaccgggtgttccaggcagattgcttcagcacaggtgcaacgagaatggttttcccccagcccatgacaacagcgcccagtgatgggaaaggtgtgctcctcgtgtttcgtggccatttctagacgattttctaccgctcctctccgaaattcttcagggtcagactgttccactcattatccctcttgctggttgtctcctgatccttagcctctttcctggaaggtttaagctaccagtttactgtcacagcctaacatacttttgcctcagttctttgggttttcattccatgcctaccttgcttcagccactcctgctgtcagatcctagacttttgcattagtgatcaccacaacccctcatccagctgaaatttcaagcacctcaccccagcagcctactccactctttccagtctgcttcctctacttccctgactccaacaaacctctgaccccaccagatccaagaagccattgatcctaggaccttcactaccatcacaccctcccttctttcttatccagttgaaatgccagtctttcatcttaagcactaccgtgcttataccctcaacttcctatcccctctctcccacgtcacactggacgggcagaactctggccctggttagatccatcttcctcctctacctcattccttcctcctctgtctcattcccacatccatgcagtggaatgcagctagagaaaaacgaaaccatgttgacttatctcactttaactcacgaacacagtcgatgttcaactatcacaacccactcccagtctacccactaccccactgaactggcttaaccctttcatttttctctctcctcagacttttgagactagctcttccaggctcacacatctcagtgtctgtgattcctgttcactttgatggaaacagaagtcatcaaatgagcttattccggggccagcgccatggctcgcttggctaatcctccgcctgcggtgccggcatcccatatgggagacaggttctagtcccggttgctcctcttccagtccagctctctgctgtggcctgggagggcagtgggggatggcccaagtgcttgggcccctgcacctacatgggagaccaggaagaggctcttggctcctggcttcggatccgcgcagcgccggctatggcagccatttggggagtgaaccaatggaaggaagacctttctctctttctctctctctcactgtctataactctacctgtcaaataaattttttttttaaattataaaaaaaaaaaagagcttgttcccaccatcatggctcctcactcacaagccctggacccaagaattccaccatccctccatgggtatcggagcactgtccatgctgccacccactacctccacttaagccaacaggcaccctcctcatgcacaccgagggcctgctctagcaaacaccgccatgagctcccacatcacaggtcagctcttctctcctggagcacttccctcagcatttgctacagaagaagtgtctgtgtctcccccaattcttgtgtggaaacctaatcctacggtgagagtattaggaggtggggcctttgagaggcaatgaggtcatgagggaggagccctcctgaatggatttgtgcccttataaaagtggccccccaaatccctttgccccttctaccacgcgaggacacaggggatgctacctgtgaggaacgggccctcaccagatgctaaatctgctggtgccttgatctttgactctcagcctccagaaccgtgaatacatttctgttgtttagaagcttctcaggctatagtattctgttccagcagcctgaacagactaacacaacattgaaacttgctagtatttcctccacttataaccaaatcaggggccagcgctgtggcataggttaagcctctgcctgtggtgttgccatcccatatgggtgccaatttggtccctgctgctcctcttccaatccagctctctgctatgggctgggaaagcagtggaagatggcccaagtgcgtgggcccctgcacccgcgtgggagacccagaagaagcccctggcttcggattggcccagctccggtcattgcggccatttggggagtgaaccagcgggtggaagacctttctcactgtctctccctttctctgtctgtaactgcttgttaaataaacaaataaataaaatctttagaaaaaaaaaaagactaaacaaaatgaacacttctctcccttccagtttccaatctattttctgccccctttgtaatacaactcctttttttaaacaaaatattttattatttatttgaaaagcagagtgacagggatagagagagggagggagggagggaaggagagatctttcatctgctggttcactccccaaatgactgcaacagccaggactgtgccaggtcaaagccaggaacccaaaatttcaatttgggtgcagaggcccaaatactaggtctttttctgctgctttcccaggcacattagcagggagctggatcaaagtggagcagctagaactcgagcctgtggccatatgggatgccagcttcgcaggcggcaggttaacctgatacaccacaaagccggcccccaacacaactcctcgagaagagttgttaacgtcctctatgtctccaaaacctctccttccctctgtcttgaaccatttctaaccaagtgttagccactactgaaccatgtgcctcacttgaaagggttcttctaagagtcaccaataaccttcatattgattaatcttgtggtcagaagcaccaaacaccaacttcccctgtcatcatgaaacactttatgtagcttgcagaacaccatgctctcctaattttttttttaaacttggttctgtgctattctctttcagtttcatcttctggtctttctttaccttttctctttcttaaaatagtctctacttacacacaatttttttgggtgatctcatctagtctcgtagctttaaactgtcaattgtatgctggcaactcccaaatttctttccctggccccaagcttctaagtgaagaataaacatatataactgcctaccagatttccatctctaacaggcttctcaaagttcacatactccaaatcaatactcccagacaactccccgagttcttcacacatgtcaggacctttgcaggtactactggtctctctgcctggaacacactccctccccaaccccggccacctctccaaatatagcaggttctccataaatactttattgaatggaagaaagaactgtacagctcctgtaggcctatttgtctgctttaaatccacaaattcatgtagagttgtgttcctggttaggattctaagatacaactctatctcttctatttcacttgatgtacaatatacacaaattcaaagtaataaactaattgaccaagataaataagttcaagtaaacatgtctgaaacctttcaaagaacaatttatcaaatgtgtaaaatcattcatttagcttccaaactatacacgaattctcattttgaacttctcaagtagtaaatattactctaatttgtgaaaataaagatttagccagactgcaaatcctaataattttagatagtaaaccagaagaaagggaacaatccaattcccctccctatccagtattcctcagctttccaaagaaatctatgtgagaattgcaaaagaagggtactctgaataagaaaatgatcttaggggtgggtgtctggcctagcagttaagatgccggcatcccgcatcaaggcccctggcctcatacctacctctggctcctgactccagcttcttgctaatgcagactctgggtagcagtggtggctgaagtaactgggttcctgccacccaggtgagagacctggattgagttcttggctacaggctcttggctttgtccctggcctaccccccaagctcagccccaaccactgcatgcatttgaggaatgtaacaagcatatgagagtgctcccttatctttcagcctttcaaataaatatcaaaaacaatttttttttaatttatttatttgagaggtaagagggagacagagaaggagagaactctgcatcttcagcaggacctatgtattacctacttctctctcacaacctgtccctatctctccctcccttaactgcacacccatccacccatcacctaacactgctcactgttcaatgccctgtgccttcactcgctcacttctgctgcccatggtccctcatgctttccacattcaccacttgcccacctgatgcttccatacttgtcactcttatttttttttttttaacgaaccacaggcggaggcttaacctatcatgccatagcgcctgcccctacttgtcactcttgtactacttttatgtcacttgttaatccttgaatacaattatcttcctgtccaacttggagctactgaaggaaaagacatgtttctacacaacagagcctaaaccttaataaaaaacaatgtgtcggcgccggcacaccgggttctagtccaggttggggcgccgaattctgtcccggttgcccctcttccaggccagctctctgctgtggccagggagtgcagtggcggatggcccaggtgcttgggccctgcaccccatgggagaccaggaaaagcacctggctcctggctcctgccatcggatcagcgcggtgcaccggctgcagcgcgctggccgcggcagccattggagggtgaaccaacggcaaaggaagacctttctctctgtctttctctctcactggccactctgcctgtcaaaaaaaaaaaaaaacaaacaaacaaaaaaaaacaatgtgtttgttgagtaaataaatcctggtgagggcagacatataatccacattaaatgaaaaaggaggggccagtgctgtggtgcagagggttaacacctggcctgaagcaccggcatcccatatggtcgctggttcgagacccatctgctcctcttccgatccagctctctgctatggcctgggaaagcagtagaagatggcccaagtccttgtgcccctgcaccctattgggagacccagaagaagctcctggctcctggcttcagattggcacagctccggccgttgcagccagttggggagtgaaccattggatggaagacctctctttctctgtttctctgtctctctctctctctttctctctgcctcttctctctctgcataactctggctttgaaataaatatttaaaaaaaaaaagaaaagaaaagaaaaaggaggctggaaaagatatgacttgcctaagatcatgcaccagatctgaataggagagggaatttagttttcttaattctatcactttgtcaaatttaagtttgcataagtggtaactactatattactataatgtgcagctttttatgttttccagaaatctcatcaagatgtcctttatcctgtagttgctctgaggaggtcttcaacttggcagaaatgaccttatgccaccatgaatacattattcttgcttgcgctgtactaagttggccagaacgcctggctacttacaggttgtttatcagagtctgagaagtacgagctaaattccttcataaagtcattctaacagagccttccccactgcgccaatgccccaggttaaggaagagaagcaggtgacagaagggcaccacatgtattaaacagggtttactctcacaactgcttattttcaagtttcccatttccttccatgggttgcaaaaacctccctaagctaaaatgtgacttggctgccttgagttggagtaaccaacaatcctctgctctaacatatgcccttgctaaaggaagcacacgttctcatttaaatacaaactagaactaattggacttgacttcctagtcctcactaagtaaatctccaaataagcctcctttctttaaacgtatcacaagactagctatgccccaaaccaaaacaaatataatgtcaaaaatcgtcagttagacactagcactctgacatatcagctagaccctaaagaaatacaatctcagttttcaacgttgtagttaacataagagcaagagacagccttttcctgctagaataaaacattttggggggccagcgctgtggcataacgggttaagctgccgcctgcagcgccggcatcccctttaggcactggttcaagacccgactgctccacttccgatctagctctctgctatggcctgggaaagcaatagaagatggcccaggtccttgggcccctacacccatgtgggagacctggaagaagctcctggctcttggcttcagatcggtgcagctccagccattgtggccagctggggagtgaaccagcggatggaagcctctctctctctctgcctctcctctctctgtgtaactttgactttcaaataaataaatctttaaaaaaaaaataaaacatttttggaagcactttattgcatccaatattctaaatcaaaatgattactgacaaatagaacatggtttgaaaaaaaaaaccagatatagtctcatccctcatatttaactctgtagctttcttctctctctcttttttttttttttttttttgacaggcagagttagacagtgagagagagagagagagagagacagagagaaaggtcttccttccattggttcaccccccaaatggccactatggccagtgctatgcccatccaaagccaggtgcttcctcctggtctcccatggggtgcagggcccaagcacctgggccatcctccactgcactccctggccacagcagagagctggactggaagagggcaaccaggatccggcgccccaactgggactagaaccccttgtgccggcgcccaggcggaggattagcctagtgagctgggcgcaggccctaactctgtagctttcaagttccctctttgtattttaaaacagtttgcaataaagatgtatatgcagctcctctctcccaacaagagagaaaaggaaatggcgttgccaacaacactgagggaatgaagagcctcgctgaacttacagctcacagcaactgacaggcggtcccctctaggggactgagaaagcacggccgcctgtccctgccacacagcatatccggcatccagaaatcgatgaagataaagacaacaggaacaaccagccatgacttgcctgaagcacatgggtactttaaaaagatcatgggaaaacagaattaaaagattaattgggggcaaaaaaatgtttaaaaccacacataccaggaatcttcagaaaagctcatggaaaacgcctatcacaggagtggacatttagcccagcagacactggtatatctggctggatttgacacctggctcccactcctgactccagtttctcatcagtgcagatgctggaaggctcaaatagctgggtccctgccacccacatgggaggcctgggctgcattcctgactcatggctcttcatgcagccagcaacagcccagccacagctggcatttgagaggtgaaccagcagaagggagctagctctctctgaaataaaaaaataaaatttaaatatgtgtattataaaaaactatgcagggggcccggtgtagtagagtaagcctccacctgtggcactggtatctcatatgggcgttggttgtgcacatcccggctgctccacttcccatccagctctctgctatggcctgggaaagcagtagaagatggcccaagtgcttgggcccctgcacctacgtgggagacccggaagaggctcctggctcctgatcagcccagctccggccattgcggccatttggggagtgaatcggcagatagaagaactttctctccacctctccctctctctgtctgtaactctacctctcaaatagataatttaaaaaacaacaaaacaaaacaaaacaaaaaactgcacagatttcaatatgttctgcaccaaaattaatttatctttcaggtcaatttttccataatttttttttttttttttttttttttaattttttgataggcagagtggacagtgagagagagagagagacaggtcttcccttgccgttggttcaccctccaatggccgccgctgcagccggcgcagcgcgctgatccgatggcaggagccaggagccaggtgctttttcctggtctcccatggggtgcagggcccaagcacctgggccatcctccactgcactccctggccatagcagagagctggcctggaagaggggcaaccgggacagaatccggcgccccgaccgggactagaacccggtgtgccggcgccgcaaggtggaggattagcctattgagccacggcgccggctctccataatatttttgaagtactcttggatgtttattttagctaatgactgtgaacgctatatgttaaatgtgatttttagttaagggtctagggtagggaaagtagacagtgatgggactagatgactaaactcctttttaacactgtcttttgagatgctatactcagacatactaagggtcctagcagttaaaaaaacaggcaaaggtatccatcaatctgaaaatctgaggatgtacatttatttcatatcagaccagtgttgaaagaacagagaggaaaagcaataaaaacaccttacattgctaagtattttcatgttatctcaatccaaaaaactcagttccagatgtagaaattgaaggggcaccagagacaaatgtcagacttggcaatacttctgttagagaggaagcagagacagaggaaaaaggaacatgtattttgcaaatcagtgtgatagtcaaaactagctctttacaagatctgaggttgtcaggatgctctcaatacgaaggtgtccaccccaccataagaaccccaatttgtgatttgctatttgttttgaaggcagaaaactgttaacatatattatgcctacatccatacaacacaacagtaaggtgagattgagactttctccctaactttctgcagtgacatcccatttaaatttcaattaagtgtaatgtttaacagaagaaacacaaacaagactgctaacctgatagttcattttagctatttttcccccagggaggaaaaattggcttattcacccattcccatgcttgagatacagaattattagaatgaaaccattggagacttgaacatttcatagagagcagaaaaaaaataaaaagtcaaccagtgagtctcatcttgcttcttaagcaccaaaagacaacatacaaaaataaacatcttactttgccacctccctctgttaaagttttgtaaggggcctccttcctcacagctgtttgtactaaacgcttggttaattcagatctcctcccctaattctccttgttaaaacaaacaggagattggtctattattatggaactggcagtctctgggttttggctttttttttttttttttttttgagtacttggaaaaactttgctaaactttgtgtattctttccaagatttcgagaacattcccccctgtcaggcagccccctgtcctataccacggcctgtctcaaagatcactttctctgttccaggcagaatgctgtcttcactcctgattctgagaaagaagtgcccacccccgacccgccgcctgctaagtagaccttctccaaccgcctgcacctcctgatcgattcctctcgtcttcaacttgtctggacaagctgcttctctcagtctatgaagtcctaaacactggctttcagcagggagggaagggggagaggagcagggagggtgactcaggaacctcctgcagtgccttttctctgccgctttacttcctcaagtgtgttcagcaccagatctttcattcttcccagcgcacatcctctgtctccaacctggcccgctgcaccgtatccgctaactcttcttcctccctaaaaggtcaggcatgtcctgaggttttcttgtgagcctcttctctcacagtttcaactgttcaccctggcctttccctcctatccacctgcttaccagaccgccaccctgcgggtgacctgcgagtccctctctcccaccccaattccctgacctttcctccccagctctcctcacctctcgatttccctatgtgtgctttcatggcaccaccacgatctctggagctgccaaaacgagaaggaagcaagacacctgccaggaaccaagaatttcgcctcaagcatccctcaaatctgtcagctcagttctacacctctcatcactaaacctctcatctgaacagctataataccctccccttccgcttcccttacctcaagcttttggtccatgccagtgccagagaaatatcccttaagcatacctttcatcgggtgtggcgtgcaagacactgcacatttctcaaacctgaacgggcgtgtggatcgcaggatgatcttactgcaaagcggctcagatgtacacagagaaaaagcgttctctagacataacctgcagcctctgagcctcctgccgcttgctcaagtccccacaactccaccacccattccttctgccacagccttttcttggcctctcactcctcaccccagtgccccacccagtgtgctccgtgtgctgctgtcacaggtctcctcactgggtcctcccggacacacagcacgctgctgcctgcacctctaaccctgggccattgtcggcaccagcaagtacccgctgaaaagtggctttgccttctaaccaaaacaaaacaccttgctatcctaatgtactcagagcaggtgctttggacatttctttcagataaacaaaaggcacttcggcaggggaactgattcattagtgagctcgggaaaattgttcaaaactgtcacttagaaatgtctgtaacattcaaagggtgcctagtgaattgtggtacatttactatttacagtagtttcaaggtaatgtagatcaagattctgatagctaattgaaaagttagtctaacttattatgatgcagtaattcctacctcagaggcttatagtgctttctaatccagaccctagccctctctggccttccctgacgctccttgcgtcggtccagttgttccatgaagacatcactttgtctttccgtgctgcgattggctgcctgcaaaacgcttccccgtcaacccacctgtcgttggtgcctacattttgaaaagtgctttacaacacgcaccttgaaggctcgtttctcagaaggctccgaaaccatgctacctttacactgggtgtttacataggaaataatgtcgacatccaagaccctacgggtgtggtccggagcactgctcattgcaccagcatccccaaggtgaacgtgatgcaggggttcggcagatctccattagagaaccgctgatctcagccctcggccagggacagacggagtcgtcggaacgaacacgcaaacagctgtcacaccgggtgattcgcgcaaggaaatgacagggcgggaaaggtttccgggaggacgaataaaaccaaataacagcgagaggcaccaagcggctcccgacctgcacgctgcactccccaagcatccctcccacaccttcgaggatgctggcgagggcctggcgccggtctccggcctcgggggtgggaagccggcgcggcccggcgctcgccccgcgctgtgcagggaggcgcccacccctgaccccgggtcgcgggtgccccctgtcccccgaccccccagaccctccgcggcgccatcgtaaacaagcccctcccgcgggtcggcgggcgctcacctgccgggcgaccgcagctcggcctcgtcctcgggttccggtccccgcgactccggctcgcccgcagctgcggggagcgcctcggcgtcctccaccgtcacctccgccgccgccacggccccggccgccggcactcgcgcggccgacgtgggggcggccgcggcccccaggccgaacgccgcctccgccctcggcgcggggaggtcgcgggcgcgcgccgcggcccgggtccccgccgtcagggccagcagcagcggcagcagcagcgcccgcaccagcgaccccgggcgggtggcgcgctccatcagcggcccgccccgcgcgcgggcatggaggcgcagccgccggcgcccgcctctcggagcctgcgatctgggcgagagcgcgctggggtccgcactgccgccccgacggcctggacagccagccgcgtctccccggccacgtctcagctcagcctctgccaccaccacctgagtgacagcctccctctgacatcgcccattgagcaaactttccgcgcttctgccctccgattggctgcggctcctgccaatccggggcccccgagctggtcctttcggagaaaacaggctttccccggttgtcaacatcgagcttaccaaccaaatcatactttcatccctccagtccaggccctcttccggacgcagttaccaatgagcaaagcgcctccccatatctccttatctcattggtgagcctcaaaggtcccggaataccttccctggagcggattggccaccctggcggttggtctcgcccctcagaacgaggcgctggcgaaggcttgaaaatcattggcggaggtggatgtccctcaaacgtctgcgctaactgcttcctgattggttggaagcgccacttagtacgtggcggattctgactgtgaagagcgctgtccctagagaaagggagagtgggaggcgagtccctggtgatggggaggcggccggcgttaaaggagctgccgcagtggctgcaaggcagtctaggtggaaaagaaggaaagataggcgaccaagcaagtcgtgaggtccctagaggcggctgaaaagggtgaaacggcgcgggaaaccggggtgctcgcggccgcggcgcagtgaccagtacagcggacgccccctggaagagctcgggccgggcagttacgtcatctgccccggaccacgtagccagccggtagcagaaccctggctctgcaccgccctgtctctcgagactgcagagtggacgcgagctggcacttcggcgaaggcgtctgaacttctctgacagtcgcgaagcacacctgcaggtgtttggtaagaagttggcatcctgcggcgatgcatcgaaaccgaggggagcggaagtctgttaccccgtcaagactgtgaagcgggcggctgtggagcccagcggggaagacgccggtacctgggatgcacagctggctccagccccccgctaatgcggaccttgtgtggcagcagtcacgggtcctgccacccaggcttcagcctggcccagcccccttggttagggacatttagggagtaaaccagtgaatgggagcttactggatctttgtctctcgaataaattagttaaaacaattaaaaaaaaaaaaacctgtgaagattttaaaagatgttgtcagtttttctgattccttgattatccccatctgcataagcaggtgctcttaatttctcccatccaaaaacaaaacaaaactcacacccccacccccacatctctttggtttctgttcagcaaagctcaacagaggtggaaactctttagttcctcttctccaaatcgggcacactacggccggcatttgtacccccgactccagaggccacccttgcgaaattcagctgaggattcacagtcttcatttcagccgtgctgggccctcggaactcagtctttgctgagccatatactttgcactttcctgcttacccactagatgagtcatcaccctcaactggtcccccattcacttgggatagaagccaagtccttaccataggtgagaaggtcccagggcgtctggctcccgagacttctctgaattcattccctgcaatgtcaggtgttcactctgtcctgccctgctggcctccccactataacaaagccggccaagtcgcaccttgagggggtttcattagctgtttttctggcctgcgaaactcttccctagtgtgttgctctgccaggactgccataatagcaaatacctcacgctgggtggcttaagcgacagaaatttgttgtctcacagttcagggggttggaaatccagatcaaggtgccagcagggttgggttctaatgaggccttttctttttgtctctcaactcttcacgtggtcattcctctgtgcgtgtgctgcccatggtgtctcttccactttgcaggatgtcagtcatattggattagctctccaccctgatggcctccttttgatgtcatcgttttagagacctgatttccaaatacatttcccgtctggagtactgggagttgggacttcagcatacagagagggaaggcccgattcagcacagagcaccaggtgcccacgagacatgttccttcgtgtcattcaaggctttgtcaccttcccagtgcagtccttcctgaccgccatatataaaattagaatccccatcgctttgcttcctgtacttctcccgtgttttatttctgcatttagtccttcaatactacacacatttatttcgcttcctgtctgtctcccttcacttggatctaagttcggtgaagatacgatcattgatagattccaggagcctaagacggtgcaaaaagtttcatgttcaccaagtccttgtcgattgagtagatagatagagggatggatggatccctgaggactgagagggaaggaagagatgagagttgctgtagacagagagggctgattagggaagcaggagtccagagctgctatagggaaaggaagagttctgtcttccacgttgagagcagggattaggaggtgcccctagagaatgttgctttgaaatggggaggaggtagatgggacagctcaaaccagttgactgctatctgctaagtaaaacgggatagaactctcttgcctaagtaagggattacaatagctgatatgaggggagtgtcaggaaatcaatacaaaccacaaaatcatctagtgtgtctgtcctaggtgagctggtcttcatggttttgtaactttttcaaaaaccggcatgagcgaggttgcttatctgagctaataaatgaagattttgctttctacctattaatgaaatggaatttgtattcattcatttaacttccacagagtatcacatggcctcttgcacgtaatgggaataaaaatgtgagtaaaacgacagaagtttgcttctgaagcacaactatgtctagttagggagacatgttattttaatcatcacacatatttatgtcattaaaacggcataagtgctacatttaaaaactataggcagaagagcagagcggtgcgaaaatgccagcaaggagcatttcctttatattccgggaaaaaaatgcaaatatttccattttggaaaaagaaagtcccgagtcaaggtcagctgactgggaaaataacttggagaaggagaagggaaaagacaacctgttggcctcaggacagcagagagcgccagggtgaccgagagtgagctctgaaatctgggtctgagcactgcagggaagggtagggaagtgcccaggtatgacagctggtctatgggtctgcctcagaaagagaagctggtacgcaggtgcccaggtcaggcattgcagaacgattaagattctaaaactgggcttagtccagaaggtcagcaataggtctgctatggtttggaagcaatttggccccaaactcatgcagttcagcccctaaagtcttatgttgatgatacaaagaggctggaaactattaagtcgcttagaggtcaacctttagcaagtgattaaatctgtcattagagtggagcccgcatgattgaagcctaatggcttttttttttttttttaagatttatttatttatttgaaagtcagagttacacacagggagaaggagaggcagagagagagagaggtcttccatctgctggttcattccccaaatggctgcaatggccagagctacaccaatccaaagccatgagccaggagccaggagcttcttccaggtctcccatgcaaatacagaagcccaaggacgtgggccatcttccagtgctttcccaggccattagcagatagctggatcggaagtggagcaactggatctcaaaccagcgcccatatgggatgctggcactgcaggcagcagctttatccactacgccacagcgccgcccccccaatggctttctaaggggagacatcgggatgtacacatgcctgtctcttgctctgtggtgccctgcgctgcctcaaaactcagatggtgcaggagtgccatcgccagaggctgaagcaatgaaatccatctgatctggggctggacacctccaaaatcatgagctgaaataaactctttgctttataggttgcctcaggcgtttcattgtagtcacaaaaagtggactcatgcaagggctgagatgcagagagaggaggctcaagccattaagaagggaatgtgctggttaagctgtgtttagttgtaagcagcagaaaactgtcatgatgtggctgaaacaagcaagaggttgctcttctcactgatgccagggcacttcaatgaagctgcgtgggagctcgggctgcgtttgtcttcccatcctttcctgggactgcttccctcgtgcctgttacctcggtctcagcacgcaaattcagcatcgtttcttcattacaggctgggaaagggggaagaaaaggcaggcaaccagttgaatcttccctatcaaagagccttccctaaagctccactagaggatttccacatccattccacaggccggaccatgtcaaacagctgcccccagctgcaaggctagtgtatggccactccaaaggaaaccaaggttctgccagcgaagatgaaggggagaatttagaatccatatcactgaagtgtaatccatgcacagtgacctgcacctgttgaaagtgtacatgtggatgggttctgagagatgcacatataccgtagtcaaggtaaagaacattcttatcaccccctatttctatgcagtccacctctctgtccacccacagtccccaggaaatcaaagacctgttctctgtcacaataaatctgtctgcatcttataaaacctttaataaatgtaatcatgcagtagatactctgtctttgtaactctttctttcagataaataaataatcttttttgaaaaaatcagagccaagcaatcaaacagcaacaagtaccaataagcagcataaatgcagagtataactttatataaatttccctcctatgggggttcccagtatatatatatttttttttaaatgtgttggggctggcgtaacgtagtaggctaagcctctgcctgtggcactggcatcccatatggtgcaggtttaagttctggctcctgcacttctgatccagctctctgctgtggcctgggaaagcagtagaagatgccgcaagtccttgggcccctgtacctgcatgggagactcggaagaagctcctggctcctggctttggatcagcacagctccagccgttgtggccatttggaaagtgaaccagtggatggaagatctttccttttttctctccctctctctgtctgtaactctacctctaggatacataaatatatctttttaaaaatttattaacttttatttgaattgcagagagacagagacagagtcagaaacagagagctgccatatgctcgttcaaatgcctgcaactgctaggtttgggccaggactgtcaggagcttggaactccatccagatctcccatatacgtagcagggactcagttacttgagccaccacttgctcagatggatgcgtattagcaggaagctagatcagaaacagagctgggattcaaatccaggcacttcaatataggatgcgggcacctgaagcagcaacttaaccatttcaccaaatgcctgccatggccattatattcttaatgatcaacaagtacagaataaaattattaaagtggctgttggggccagtgctgtgcacagtaggttaatcctccgtttgtggcgcccacatcccatatgggcaccagtttgagtctgtctgctgtacttctgatccagctctctgctactgggaaagcagtagtagacggcctaaatccttgggccctagcacccccgagggagacctggaggaagctcctagctcctggcttcagatcagctcagctctggccattgtggccatctggggaatgaatcagtggatggaagacctttctctgtctctccctctcactttctgtaactctacctctcaaataaataaatcaacttttatttttaaaggtggctgttttatttcaatgatttttaaaaaatatttatttatttgaaagtcagaggtacagagagagaaaagtgtaagaaaaagtctggtggtccattttcaacacagaatggaaaattactgagggctgaattgcagatctagcaaactcaccaggcaaacaggatgttacagagtcgtcagctcacaagaggaaattaaagttcagagaaggaaggaggagggtagcaacttaggtgaagtccaggaagattttaccctgcacagtactcagccaatggggaacaaggagtctgcgggctaggctataagtcgctgctataactgctcctggtgtggctggctgctcatcaggcagcccttcttgcaagaccaatgataaagtctctctttcactgcaatttccgagtccaagcccatctcttgagtggacagatgaggctgttttccaaagaaagagagatacacatagagataccttccatctgctgatttattccccagttggccacaacagccagggctgggccaggctgaagcccagagccaggagccaggaggttcacccatgggtggcaggagcccaagcacttgggccatcatttgcttgctttcccaggccattatcagggatctggattggaagtggagcagccagaacttgaactggtgccacaggtgccacaggtggcaactttaccagcctatgccacaacaccagcccacttcaataattttttttttttttggacaggcagagtggacagtgagagaaagacagagagaaaggtcttccttttttgttggttcactcctcaatggccgctgcggccggcgcattgcactgatccgaagccaggagccaggtgcttctcctggtctcccatgcaggtgcagggcccaagcacctgggccatcctctactgcactccctggccacagcagagagctggcctggaagaggggcaaccgggacagaatccagcgccctgacggggactagaacccggtgtgccggcgccgcaaggcggaggattagcctagtgagccgcggcgccggcccacttcaatgtaatctaggaccatgtggctcagcctttttggcattgcaatccccaagtttgcatttgtgtccatcactgtataaaggtttcatttcttccaaataaataccaaaaaactgggagtttaagagcaagtctttcacagtggctcaaataagaaaacatgataagagaatcaaattcttttcctacacgtagttttgtaagtaggccagattgaaaagaacctacatcttagctgtcaggattgtgtttgctctcagagtggtgctgcaatttcattaaattatcatctgttgggcatctgtttccagctctgacacagtacctggtattaggccagatatcccactgagattgatatgaaactcgattttaaagaattctttgaaatcatcagaatgcaaccaagttatccaggacttgagggactgcgaatggagaagaaaaagcaattatatcagagtcacactttctacggttcctcccctcaaggcatttgttgaattataagctagatgtgcagggtacagaggctatgtaaaaaggtgtaatttcagagttttaggtgcctcataaggctacagaaacagaatgtggagttcagggctagcaacaaagctaggatcggaagagcttagagaaaagagaattgtcaaaaggtgaggctgacattccagcctactttttgcatcaaagtgtttgcagattcataagtcatgcaaataagagatcagaaactcaaacagaaagaggcagacaagaggttcagacaggaagtagttacattgtattgaagattcaaaacttgaaggtcctggggcaggtgttgtgatgaggtaggttaagccaatacctaggatgaacacatctgatatgagtacctgggatgactcctgcctctgcttctggtctagcttcctgttaatgtacctgactcaagtatctgtgttgtgctacctatgtgggagacccagatggacttcctggctcctagcttcagactggcccagccctggccaagcatttgaggagtgaaccagcagatgaactctctctctctctctctctctctctttttctctcccccacacacccccctctaaataaagaaatagagatcagacctaacaaggattcaaaactctaaaaaatatttccaggctttcaattgaaactcctggcaaaattcaaatgggagtgagggcaaagtggaaataaattaaattagcttcaaaatacctaaaacacaatattaaagtaccatatctctaattggattaggatgagctagatgtagaaaaagaaaattaagttaattctgtagaagttaattctataatcatacagaatttttacaatgtccagcgttcaggggccagagccgtggctcacttggttaatcctccacctgcgtcaccagcatcccatatgggcgccaggttctagtcctggttgctcctcttccagtccagctttctgctgtggcgcgggagggcgctggaggatggcccaagtccttgggcccctgtacccgcatgggagaccaggaggaagcacctggcttcggatccgtggcggccatttggggagtgaaccagaggaaagaagacctttctctctctctttctcactgtctaactctgtcaaattaaaaagaaaaataaataaattaaaaaaaacaatgtccagcgttcaagcaaaaatctatgtcatgtcaataagtagaaccaagggacagaaaatcaaaagaaaaaaacaggaacagattagacctacagaagattgggatattggtattatcagatacaagctataaagtaattatgagtaatatcctaaaagtaagatggataatttcagaaaaaattagaatccataaaaaattaaagtgaatagttcagaacttaaattacttgacatacaaatggtccttaagtacatgaaaaatgctcaacattattagtcatggaggaaatgcagatcaaaatcacaatgaaatatcactttataaccactagaatgcttaaaatcaaaaagacaggtagtaacaagtgttgggcaagatgtggagaattttaaatattcatacattcaacaagtgttgacaaggatgtggaacatcttaaactttcgtatatgccaggggatgtaagattgtgtaacacttgaaaaacagtttggtaagtcctcaaaatggaaaacatagagttatcacataactcagaaattctactcctagatacatatccagagaattgaaaacatggccacacaaaaacttatacacaaatgttcatagtaacattatttgaaatagtcaaaaattataaatgatctaaatttctatcagcttaggaatggataaataaaatgcgggccatcaatacaagggaacactgtttagtgataaaaaggaatgaaatggccatgtataccactacattcatggactaagtaaaagatgccagttataaaaggccatatattatataattccttttatacaaaataagtaaatctatagctacagacagcaatttagtgatttccagtggctgggaggagaagagattaaggaatggctgctaacaattttggagtttctttttggggtgatgaaaatgttattaagttagattgtgactatacaactctacagatataaaaaaaaaacaaccctgaattgtacactataaaagggtaaaattttatggtttgcaaattatagttcaacaaaggtatcacttaactaaaagaaaaaataaattaactgaagttaacaacagaagagagaatgggaggactggaagaattctcggagaaacatttccaaattgaatcacaaagaagaattcaagagaaattcagaaaaaacaaggaggaacattgtggaaaaggtctacatatgcataactgaggtcttccagaggagagatggcaggtgtagaacttgaaaaaatagtgatcgggaatttacaaacattggtaaaagatagaaggaaaacacaaatgaaaagaaacttcaggacacagactgaaggatttctttgacccccaagcaatttaaaaacaacaaaacaggacaaaacaaaacaaaaacaacccttatgtagatctgtcttagaggaacttctgaaaaactgagcaaagacaacagtaaaagaagcttttgggggaaataaactttgtcttccgaggagcaatagtgacagcgacagatgcctttccaacaaagaaatgacgttaaaatgctgaaaaaaacgaactggaaacttgaacttctaatattacacctgaaaatatctttcaaaactaaaagcaagtaaaaatatttacgaaaataagggaacctgtggcctgagacttagtgggagctttgtggatagagggaaaatgatccaagatggaatgttgaaagggtaggccaggagaactgaggattattagtaaatgtggtgataaatacaattgaaaagttactatttttaaaaataatagtatcttttggggtttaaatatatatttactattaaatgtacattcccagtggcagcttaagcagtgtgccaagctcctgttgcatagttttttcataacatacattttaatgaatatcttaaaaatcctttgcatacatggatttcaagattatttgcctcaggagctggtgctgtggcacagtaggttaatcctctgcctgtggtgccggcatcccatatgggcaccggttctagtcccagctgctcctcttctgatccagatctctgctatggcctgggagggcagtagaagatggtccaggtccttgggaccctgcacccaactggggaacccagaagaggctcctggctcctggcttcagattggctcatctctggctgttcaggccatttggagatggaaccccataggatggaggacctttctctgtctctccttctcactgtaactctacctctcaagtaaataaataaaaatctttaaaaaaaaagattatttgcctcaaaataaacttacccttcaattccattttctatgttttttttaagtatctgcatatcttcgtatgcaaaaaggtatgcatgcaaacaataggaaaagaaagctgccagaactgtaagtatctggcaaagctgatttttttaaacaattttaaaaattttaatttttttagactttatattttggagcagttttaggtttacagcaacattgagataaaagtacgaagacttctcaatactcctccccacctgcctcccaccccccaagtctaacacactagtgacatcagcaccagagtggtgtattcgctacaacagatgaacctacattgacaaatcattaacacccaacgtccatagtttacatagggctcacccttggtggcgcacattctgtgagtttggacaaatgtgcaatgccatggacccaccactacagtacggtacagagtagcttccctgccctaaaaattctgtgttctacctgttcatccttcctccccctgctctgaccccaactaccactgatctttttactgtctccatagtgtgtcttttccagaatgccctaaaatcagaatcatacaatatgtaacctatttaggttgccattgttcacttagtaaatgcatttaaatttcttccatgtcttttcaggtcttgatatatcatttcttcttttagttctggataatattctataacctggattaccaccttagggcaggtgatatggcctaactggggccagggcttcgcatgggtgctatgccacaacaggagctttggtctttccatctctgctaagttttctgacttttacacccaactccatcaacagctaaccctgcaacatctattctcagagaatccaaagaaaattcttcccttcaatccacggacatgccctactaagcctgagtcaccaacaccatgccatgaataggagaaaatgagggcttcaggggaacttgatgggcacacccatctcaggaatcccctgggaccaggtcaatgcctgtctccagaggtattgttcagtgagagctattttcctctggaatgaaatgtgaaggggctgggtgttgattagggttgtaaccagaccttgaggcagaaaggcagtgagcgcacaagtctctgctatggaagacaaattgacaaaggagggacatagcacacaggctctgaacatacacaaatccaaccaggtacactcagcagaaaagaatcgaggaagacgagaggaagcaaaagcaaaaggaggcaaagaagggaggcttcagagaaataccatttaaataacacgggcgtttgtcttcaattatgtgcaggtgattctgctcagcattccatgcagtgttgcctcgatgggtttgagaaaggagaactgacatctcctttccctttactgaggtgagattcagtcttgactgtacttggattactgggggcgctttacaaaaataagacccctgggccccacccttggagagtcagaggtacagcctgagcttccggattgctaaaagctccccaggaaattctgatgtgaggccaggataaaacatgtctgcggtgggtcgtggctcttaactcactgccccagtgagtttgtactgtgctgagtgtttaaagacaggtatctggggagggtgttgcggcacagcagggtaagtcaccacttgggacacctaagtgtgtcagttccagtcccagctactcgccttccagtccagcccctactaatgcaccttgcgggaacagaagatggctgaggtgcttggactgctgccgccccgtgagaaaccatgacggagttccacgctcctggcttcagcctggcccagccttggctattgtgggcatttggggagtgaactaggaagatatctttctgtctgtctgtctatctctgtcactctgcctttcaaatagatgggaataagtaaacataaaaagatatgcatttgtcattcaaaatcatccccaaatttaagtctataatttcatctggtgttcagttgaggaaaaggcaatttgttccaatgttgcccatgacttattaaaaatttatatgggtctatgctgttctttgtggtatttaagagatttttcaatatttttaaaatatttatttgaaaaaagtgggggccggtgcagtggcacagtaggttaatcctccactttcgaagtgacatcccatatgggcgccgttctagtcccagttgctccacttccaatccagatctctgctatggcctggtatagcagtagaagatggcccaagtgcttaggcccctgcacctgtgtgggagacccagaagaagctcctggctcctggcttcagatcggcacagctccagctattgtagtcatttggggagtgaaccaatggaaagaaaacctttctctctgtctctccctctcactgtctgtaactctacctctcaaataaaataaataaaatcttaaaaacgaaaggaaatgtgacagagacaaagagtgagaaagagagagagagagagagcttccatctgccagttcactcctcaaatgaccacaagagccaattcagggtcaggctaaagccaggagccaggtactccatctgtgtcttctgtgtggatggcaggagtctaagtactcgagccatcatctgctgcctcttaggagtgttggccaagagttaatatggagcagccaggacttgacccagaactctgacatgagatgccagcttaacccactgcaccaaaataccggcctccaaaggggattttttttttatttgacaggtagagttacagacagtgagagagagagacagagaggaaggttttccttccgttggtttaccccacaaatggccgccacagcctgcgctttgctgatccgaagccaggagccaggtgcttcctcctggtctcccatgcgggtgcagggccaaagcacttgggccatcctccactgccttcccgggccacagcagagagctggactggaaaaggagcaactgggactagaacccggcgcccatatgggatgctggcgccgcaagcggaggattaaccaagtgagccacggtgctggcctctcaaaggtgatttttaagcccacccattaccccttcttcctgttcccaaatcgataccagttttttagtgtcttataaattctttcagaacttcttcatgaacattccactgatgcaaatatttttagttttccccattgtttctgcacaaatgttaaatactatgttgtattctgtacctttaaaaatgttaagaatatttaagcaccctaccatctggatcataagtgctaagcaacaattttcacttaaaggaaagaaaatttttggagaaattgcttgtttcagatttggacaggcaatgtagatgaccctggaagaacctgccttccaaaaaaggaagaaagctctgaaggcagtggagccccctgtgagggattcaggttccatactgtggaggctcaccctgggcaacaatggggcaaggtgagtactgacagactgaataccagctaatgcgtttgagttcatcgtttcataatggtattctaaagcacaacacctttggaggagtgtcgaaacctcagcaaaaaccttgggaactaagcttttttttttttaaacatgtttttctttgctcgctgtacttcttttttaaaaatttattttaggctggcgcagtggctcacttggttaatcctccgcttgcggcgccagcatcccatatgggcgccgggttctgtcccagttgctcctcttccagtccagctctctgctgtggcccgggaaggcagtggaggatggcccaagtgcctgggccctgcacccgcatgggagaccaggaggaagcacctggctcctggctttggatcagcacagcgcaggctgtggcggccatttgtggggtgaaccaacggaaggaaaacctttctctctgtctctctctctctctcactaactctgcctgtcaaaaaataaaaaataattattttatttatttgaaagagagttacagagagagggagacacacacacacacacacacacacacacacacaggtcttccattagccggcttactccccaaatgaccacaatggccagagctgagctgatccaaaatcaggagccaggagcctcttctgggtctcccacataggtgcagggtcccaagtacttgggccatcctctgctgctttcccaggtgcattagcagggagctggatgggaagtggagcagccaggactcaaaccggcatccatatgggatgccagtgctgcaggctggagctttaactcactgcgccacagtgttgggggaactaactaaaagaaagagaaggatgagccaagcgtttctatataatctatagaaaattaaagtatgataaggaaagtttcgttcaacctctcatggattaacagaggaaaggcctggagatgaggcagtgacatcccaagagagagagagggaacaggatgcgacaaaccttccaaaatatacaacactactaataaagtcacccgctacggtggtgggggagggggagagggagggggaggagccgctgccaccaagtgggatcatgcctgtagatgtaattactggttcacaggagagacagagaactgaagaatattttaaatgactacagggatgcataagcaaaatccagactatgggaaactcaaataattacaaggaggaaaaaaggagatggaggggctcccagagattaaataaaagagatttgagtgatatcaagcaggctagagaccaccatgctcggagatgcctgtttacaagagtggcccttggctggcctctggagatgtgggtttcaggaaggttcccacagttccctaaaagatgagagtggctcactgcgcctaaactattgtataacgtggtctgtgattatggtgaacacctgctttcagcctgggaaactggaacttgggtacgtgctgggcagacagtgtctgtgtggccaggtcccactaaaagccctgcatccgaacctctaatgagcctccctggtggacagcacttcctgcttgtcattacggtttgatgctgggggcgtgagcatgtcctgttgtgattccactgagaggggagagtcttggaagcttgtgcctggcttcctctggactccgctgcgtaggcctttttccattgctgattttgctttgtagcttttgctttaataagtcttagccatgagtacagtcattggctgagtcctaatgaatcactgaacttgggagtggtcttgggggcactggacacaacatcttatttggaacttgattcaaataaacaaacaagagtcagggaaatttgagctcaatattaatgataccagtgcatcactgtttatattttcagatgtaataatagtattgtggttgtgtttaggagatacttagattaaaacatttgtgcatggaataatattatgtctcagactggcttcaaaataatctgatggaagggttgggagtgggtaaagggtataaatgggaaggattggccatgagttaatagatgttgaagctggacaaggggtggtgtctatgagtcttcattgtattcctttgtatatgttttcaatcttccatagtaaaacatttaaaaagataatgtatctttttttttaattttttgataggcagagttagtgagagagaggcagagagagagttatcgacagtgagagagagacagagagaaagatcttccttcgtttgttcactcccctaatggctgctacggctggcgctgcactgatctgaagccaagagccgggtgcttcctcctggtctcccatgcgggtgcagggacccaagcacttgggccatactccgctgccctcctgggccacagcagagagctggactggaagaggagcaactggggctagtacccggtgccccagccgggactagaaccccggggtgctggtgccggaggcggaggattagccaagtgagccacggcaccggcccgataatgaatctttaacatattttcatttcagctcctataaagcattctcaattttgttttcttatttgtttgtttgtttgtttgttttactatcttaaagtgtccattgtacaaagtgttttccagcccaggtggatttgccttctctggaatgttacctcctgtctcgtgaaccttcagctggagctgtttgccagctgagctccaggaatcttgtcctaactcactcagataaatattgatctaaaagagtggtagtgtcagccatcagagagcaggtgggcaatggggtgattcctagaggacttccttgctgttgccatgggaggctctctgaggtggaggctcagggttggcagaaccatgggtctggagtagactgaggatgaatcagcagcactgtcttgtcagcatctctaggtctttgagaatctagaagaggtggatcccagccaggggacaacagaactgtgttttcagggtgccctgattttgtggctggtggtattcatgctatcttaggataattgacccccaaggctttggggaatgtcagtgaagtttatttcttggcaagccccagaaaccaactccaatcatttgaagagaaattttaaaaatatatgttgttgctggaaggatatgggctagctcacagaattacaggaaaaaccaaacaactaagcctctcacagtacaggagccagagcagctttgaaggaatccaggaagtgggtccccacagacaggctcttcggagaaatatgatcaggagttaatcatttcaattattttctttcctggagtcacaatgtccaagttcacattccctggacagaggaactggttgactaagcttggattatgagtccattcccagtggatgacatgcaggccccttggtcaccagtcccctcacaaatgcacatggacagttgtggaggggagtgttactccagggaaatctgggtttctttatcagctaaataggtgcatggatcctgagcagacaaaaacgacaaatgtccactctaaggagagggagagctccggtgtgtgcctcagcctggccagctgcacagctggagtcccaggaacactggtgggctgtagaggatagcccagaccctgacttttctcttagtaggtgtagcccaagaaacaatgggaggacatgggactgtcctgccttctcttgttccacagaaactttttttaaagcttcatgagtattagaaacatatatttaaactaataaacaaaacaacatgaaaggtttctggatgggagaatgtgcaatgacttccagttgctccaggcatggagcctgctcacgaagaagatggctccagttcttggcctggttattgaaaggctatttttttgttcctcccaagtgtcctgcaccaccatctcacataaatcccactgtttgagaggctcatgttgtccactgagggttgctgccctgtgtggccgaattgtgaaaatatagacagtgacactcctgatcataaaaccagagcaatccagaaaaactcaggagggcatatttaggtgagagttactgttgttactaaacagtggaatggggctggcactgtggtgtagcaggctaagcttccacctgtggcaacagcatcccatatgggcactagttcgagtcccaggtactcctctttcaatccagcaagttatggcctgggaaagcagtagaagatggcccaagtgcttgggcccctgcacccatgtgggagacccacaagaagatcctggctcctgtctttggatcagcccagctctggccattgcagccatttggggagtgaaccagcggatgggagacctttctctctgtctcttcctctttctgtctgtaactctgcctctcaaataaataaataaaatcctaaaaataaataaataaataaaatcctaaaaaaaaaaaacagtgggattatttccacaggaagctgtggaatttccttcttagatatctttaaataataaataaatttctagctgaacaccaacttcaaggtggcttttctgggtgcctttaatcctaatgatgaagagttaaactgtaaaaataaaaattataatatgactttaacttataattttgatattattttgggaacattacatagttcttagtatagtaatctcttttttgtaattataacaaaataccagaggcagcctaattatgaagaaaagagcttgagctcacggtttgtcagcctggaagcccaagatcagaaggtcccattggttggacctctggtgagggcccaagatgaatggcatggtgggagcacatgtgagagggcgggatctcatcaccacacaggaagccagtgagtagttccgggtcgggcttgcttttttatgtgacaacttggggttcctctgagggctgcctcccatagcctaagtacctcccactaggacgcaactcttcaaggctccacaccttcccccagtactgccaccctggggaccaagcttcccaaacaagaacccctggggacaaaccacatccagactgtggcacctggctttcatgttttgaagttcggttgccaagccttagaggtgaggtggctgttattagtacacattatcttcagacaggtgagaagcccaggagacaacagtgacaactttgcattacccacaatcatgctgagtcactgcgggaagctcccagcttcttgctgtagctctgtcttcttcttcttctttccctccccgcctcttctcttcctaccacgtctgcatttattttgagaagaccacagcattaatggtatcattagagggtgctaaatcttagctttgaatggtcacagcaggaaaataaattcttgccttctttttactccctactcttctctaactatagataattcctactgcatgcactcaaaaatcagtgcagctggtcatacagaaggctggagaaagcaggtggaatcagtgctgatccagagctggaacagtcattctgagaagatgtgccattgattgggagtcagcagcctcaccttcatggctataataacagcagaatggaagtatcgtcttggtagaatcttgaccacctaactccaaggtcatgtggctctccatttccatctgtttgtgttgctaatccctgcacacagtgactgattaatgggagtcctgtcaattctcctctagaacagtggtcagggctgggtgcaaggaacattctgttctgttccaggaagataaaggaccagatggcatgggcgtcccagagtctctggttaactgccatgccctcagcgtctgtacacctcctgggacatagtaggttctcaataaatatttgacaatgtgaaagatgcagatgaatggctaacttgacacatgtttgcacagacttgttctggtgttgagaatatggggctccacccttctagtgctgagtttagcgtcgccgggagaaggaggagcgctgtcccgtggttcagtgccttcctttaccagctgcgctgagtgacgtgatcaagaggcctggaggacgtggtgatgtcagttccctgagcgtgcccctgtgctctgactgtaggaacatagatttctcccttgctcttcctgtactttgaggaggacgtcactgctccctttcctgcagtctgcagctcctggccaccctcctttcactttggaagtgactgtcttgcagctcctgagtgccctaagcaggaaatgtgggcttataataacctcttcctgattggcccgggaggttgtgtggtccgtagggtgacagtcacctgatcctctagctccacttccttcagagaggccaagagtgactctgaactgttttcctgaaacgcctgagacgagtggctggagcctggctgcttgtgggcggggctgggaggatccagggcctgtgtttacccgtttattaagggagatctagcagaagttggaaaagtgaggtcagagggagtcacaacagagccaataaaaataaagcccttagtaaacaagaatgaagcatggaggcagatggttggcacagtgattaagtcaccacttgggatgcctgtctcccccatctgagtgcctggttcgagtcctggctcctctgcttccaatctagcttcctgctaatgagaggcagcagatgacagttcaaatacttgagtgactgctagccatgtgggagacctggatagagttcctggcccctggcttgtctctggctcactctggcttgttgtatgcatgtggggagtgacccagaagatagaagttctctgtctctttctttatctccacctttccaataaaacgaaacattttttaaaatggtttttatacttggtcatgaattcagggggttccaggaatggtcaatttggctgcagaaattgaacagaattgtgggaaagacatacagctgtgaaagagggggatggatcaccaagggcctcttgtgccagataagggagttttgttctgtgagcaaaaagaacacaacggaggggcaggcatttggcccagcgtaaacacatctgttaagatgcccatgccccacatcacagcagtgatgcctcaggtaattgggccctgccacccacatgggagatctggattgagttcctggtcctggcctctgccaccagcctctgtgggcatttggggagtgaaccaatggatgtgggctttcttgttgtctcttgcctctgtgaaaggcaaaacagaaaggttgggggctgagcaataataggaaaagcgtctttaaaggaagattgctttcccactagttcacgtgttctgtgaaacatgtgtcccaagaaatccttcttggaaaaaggtcccatggacaaggaggtttaagaaatccagtccactctagttctgggatctcctggaaacttataaggcactttgtcttcgggtctctgagaagtcctgagaaacttgctttgctccgtttaacccagggagaaagaagagaatgttactgaagatcggattcaattttctagctagtgccacacacacacaaaaccacctttcttcaataatgtggacgtctttgagatggattcttaggtggtgcctttatttgccaccatgtagttcagttcatttagctagtgtggagcaggtgttcagtgcagcagttaaacaccacatgcagcacgctggcatcccaatattggggtgtgtcgctccccctcttcgtggaggaacgacactaaaccctgactaggcttcatatcagagtcacggcaccattatgtcgctccccgtcttcgtggaggaacgacacaggaccctgcgttgttctttcgtctgctcggccctccccgggtttgctgctggttcttcccgggttggctgctggtccttcccgggttggctaccatcccttccacctccgtggaagggcggttccccctgccacattccctacttctgcgggggagcggcacactgccggccggctctctcgggggggctgcacaggtgttccccttagatgttcctggtgcatgttgtctctctcctcctttatagtcctcatccgccaatcccaactctgctacccacacgccgagtacgctgctctcctccaatcaggagcaagatcagctcctgcagctcagtcaatcaagttggcgagaggcagctgcatagaagttgttgctcccttctcagcgccatattgtgggagagcagatgcatagaataagtcaattccggtaacttagtctagtccgggttgctccccacaggggtgtctgagtctgagtcctggatcactttcaattccaacttcctgtcaatgcaaaccctgggaggcagcaggtgatggctttgttcggtccctgccacccgtgtgggtatcatgggctcctggcttcggcctggcccgtcctggctattgtaggcatttagagagtgaaccagcaaatgcaagatagatctctcacacacatacacacactctgctttccaaaaaaaatgaaaagaaattttaaaatttaaaaataaaatatttagctagcatgtccaaaccccactagccagtgacctcaatgtaaattttcatgacagcaatactacagaattcactgttcagtacattcagcaggagatctagagactgtcctcggcagaaatccctggaatacccacagggagtccctgtgtctctaggctcagccctttgcacttttattcagttctctttcctgcctagtttggggaacaaaaacagcagcgggacagtggcctcccttggtctgacccagacgccagctcatgtggttcgctctgaaggctgcactgctcctcactgcctgctggccgctgtcctcattcactgactcctgtcagatgactctgctccatgctgtctctcttccggccagctgggaaactcactttaaagatactgcttgtaggagagctgcagagcacggccgctgcgtcatgtctcctttctcaaggcatacaatttgacaacagcacaagtagggatgatggagagagctggacgggaggtcagggtaggcaccagaaaaacagatccaataggatgtgtatagacagataaacgagtgtctggtgggcttggatggatggatggttggaggctgggtagatgggcagatgataggtatggttaacagggagacagacgacacgtaggtagatagatagaggctcatgccatcattggggctggtgagctgacagctgcagtatggtatgggccagtgggattcagacccaggggaaagttgatgctgcagctggagtctcagggcagtcggcaggcagcttctcctttgcattagggaagcttgatctttcctccttttttttttttttattaaaaaagatttatttatttggaaggcagagttacagagaggcagaggcaggagagagagagaggtcttccatcggctggttcactccccagatggctgtaacagtcagagctgtacccatccaaagccaggagccaggagcttcttccgggtctcccacgtgggtgcaggggcccaaggacttgggccatcttctactgctttcccaggccacagcagagagctggatcagaagtagagtggcagagactcaaaccagcgcccatatgggatgctggcactgcaggtggcggctttacacgttgtgccacagcaccggcccctcgatctgtcctcttcaggctatcagctgactggatgaggcccaacacattttggaggaaatgagtgttttcttcaaagcctgttgctttaaatgttaatctcatctgcgacatatcttcacagtgacctgtgtttgaccaaaacctaaatgccatggcttagttgggttgatacataaagttaaccatcacaggctagctagaggggattgttttctgaaactaaaccttggccaacaaaccaggtgtcataataagagtcagcaaaccagtagtgggccaaaggtaacacctggaaaacaggcaaagctgaggtcaaaatgaaagtttaccaggaagcaagtggaagaggcagggaattcatgtggacatacttgatggtaaccagggttcttatttattattttaagatttatttatttaggggccagtgctgtgacgtagcaggtaaagctgccgcctgcagtgccagcatcccacatggatgctggttccagtctcagctgctccaattccgatgcagctctctgctatggcctgggaaggcagtagaagatggcccaagtgcttgggcccctgcacccatgtgggagacctggaagaagctcctggctcctggctttggcatggctcagctctagccattgaggccatttggggagtgaacaagcagatagaagataagactctctctctcttctctctccctccttccttcttcctcctctctatgtctttcaaataaataaaaaataaatctttttttttaaaggagacccagggctggcattgtggcagagtgggtaaagctgctgcctgtgatgccggcatcctatatgggcgccaattcgtgtcccggctgctcctcttctgatccagctctctgctatggcctgggaaagcagtggaggatggtctaagtgcttgggcccctgcacccacggggagacccagaggaagctcctggctcctggctttggatctgctcatctcccgctgttgcagagtgaactagcgaatggaagacatctctctcttgctctttcccactttctgtctgtaactctatttctcagataaataaataagtctttaaaaaaatgcaagaaatgcccgtaccccactgacgtcagaggagagaacagcagtgtcctagggggcctgtgacagctcaggctacagttaggttctccccgcgcgggtggggcagcagctcctcccatccccagctgctgcccttctcaggcaccttcgtgcttggggattgtcagggcagagctgtgagtcattatcacgggatgcctgtgtctgttcccaccccagcccctgccagatcaaacacacgggccatggagccctgagccttgtttaccttggaagtccggcgcagccacggcagcacatccacggctgaattacaggttctgcctcactgtcccccgtgctcccaagttcctagcatcactgggaagactctcccaggagacaaccttcctggcccaggtgacccaactttgttcaactccccacgccccactcctccaacttatttcaagtatttctttgctggctgctcagagtcatacttttttttttttaaagatattcatttatttgagaggtagagttacagacagtgggagagagagagaaagtcttccttctgttggttcactcctcaaatggccacaatggccagagctgtgccgatgcaaaaccaggagccaggtgctttttcctggtctcccatgtgagtgcaggggcccaaggacttgggccatcttctactgccctcccaggccatagcagagaactggatcagaagaagagcagccgagactacaaccagcgcccatatgggatgccagagccacaggcagaggattaacctattgcgccacagcgctggcccccagaatcactattaaccaaaagctcctcatagcggaaagcagagctgggtgatgcatgaactcctgggccttggagatgttagagtactgaggacagacaatgtgtctggttgagtggttttattagcacagctgactgattcatttcctttttcctcaccggagtctcattcctgaatcgctgtccatacaaaggtggaatccggtgcccagaggagccggtggcatcacaatttggggaacctgctcaagatcacatctcagagctcttgcctttgccccctgaattctcaccaacacccgtcactggagctgccagcaccgcagtgtctgtccctctccggaagctgaccgcccagtggcctggcttgccagacgtgcacccacgctgccgcattcgtgggctcactcaattcaaaggctgtggcaggtgcattctgagattcagcaagaaacttccagtagttttctgttcagctccagtgtcagcctggagaagaggaaacgttcccgggatggggcagcgaggattaagaacgctggaaggcgctcgctcgtttcctggtgctcacattctcctgcacggttggcctccatgtctgtggcttccacaccgaatgcagatcgaaaatattttaaaattacatctgcattgaacatgttcagacttttttcttgtcattattctccaaatacagtaaaacagctatttctatagcattcacatttatagtatgtgttataagtaatccagagataatttaaaatatgcaggaggatatgagcaggttctatagaaacaacaggccatttcacataagggacttgagtgtctgcagatttcgatgtccacagggagtcggggagccaattccccacagatctctacccgcccatctctccttttactgtgtgctttcaaggtaaggaagcatagacaggggcccagtgtctgcctttgaggccgtcatgcctgggtccatgccatctacagggcttcatctgtaacgtggggcatgggctgctggccggggagctgctgtaggcagctgtctctttcctggtagacatgtgcccacaccctcccatgatggcctcaccagtccgacactgtgagttagagtcacgtagcaggagcctcctgagttgtttctctgcctctgccctggctgcctccagtctattctgcccatggcagccaggtgacctttgtacagcacacacggggccccatcttgctccctaagactctgagggcttttctgaaccaagaacaaagtccagaccccttatcaaggcctgcaagtcctggccactgcccaccctgaaaccctccctcccctctcccccggccctgcttcttcccatttcccaaggcgatgatgcactgagtggtttttgcagctcctccttggcacttaccaggccctctgtctgcaaccctgtctccctggaacttcggatatctgcctccttcttttcattcagggctcagctcaaatgccacttcctgagaacccttctgcccacccaaattcatgtcccctcccccaccaagttattctccaccccaacactgggattttccagctttgctgactcagtttgtgtttggatgctatcccaggatgcaaaggcagctctgagtccacctgagagagggacaggcactggctggcaggccttgtgacaggaccagggagagaagagaggccatctaggaagggtgaccaactgtttcagtttctcaaacttccatgggatgtgggattttcaaatcaaaaaccaaaggacaaatatttattgtaataccttggatcacttcatacaggaggacttgaaaggaaaacaccttgcagggctggcgctgtggcgtagctgataacgctgctgcctgcagtgccggcatcccatatgggtgccggttaaagacccggctgctccacttccaacccagctctctgctatggcctgggaaagcagtggaagatggcccaagtacttgggctcctgcacccacgtgggaagtgcggaagaagctcttgactcctggcttctgatcggtccagctctgggccttgcaaccttttggggagtgaatcagagaggatggaagacctctctctccctctgcctctgcctctctgtaactatgctttccaaataaataaatatataaataaacacatctttaaaaaataaacaccttgcaataaatacaagagacacacataccctaagagcaaatatgtcccacagcctgaacatttaatatggctctagccccaagttcttcgtagagtgtgaaggtacttcaaaaatgtcatgaaaatatgcactatagatttgcatggatttaaaatttttgacactaaaaataatgttgtattttaattttattttccatgaatttctgaagtacccttatatctaacataggaacttgataaatatttgataaactgagtttaactgagtacattattggatcagtttaaaacctcagagtcaggaaatacaaaagaaattgggttgttctagaaattcttcacagcagaaaacagacttcataatttaaatacagccaaggaaggcctctggagaccaaattatctaattggtcagtctatggagggcatggtctgccacctgctggtagtttgtggcattgctccctgggaaaccacaattcctttgttgagcagatttattggataatcatagaaggtaaaggctgggagaatctctatgctacggctgtatttttaaccgctaaaacagtgcaacctgataaagaatatttttacattatttgttcattcttgaatgtgggaaacaatgtatccacaatgaggtgaaaagagagaagagggaagcaacacctatggaatacttagacgaagcagacattctacaaagcttatttctcctcacaacaaccttaccatatgtgtgatatcttatctaccttacagacggtaaaatggttactcagagagcttaagacatttcgttgacattaaatgagaaagcaaaggacacctcaaagattgaaggccagtattttctgtctctgaagtgcgagctcaggcagtttacttacaacataattgtatgtttttaacttgttgcgttaaacagcagatgacgacccaagtacttgggttccttccacccctgtgggagagttagatggagttcctggctcctggctttagcctagcccaacccactgctgcagccatttgtggggtgagccagtgggtggaagacacctggctctctgtcactccgcctttcaaatagaaataattaaatattaaattaacgttcttgaggtggagggtctacccttgatgatccaagtgggttgggtggaattgccagggtccctttaagagggaagcaggagatgagagtacactgtagatgtgacccccagaaccaggatctggaaggaagcagctgtgagccacgaaatgcaagtgcctctaccagtctgcgacaaagatgagctaaaaactggttttctgactcagttctgtattcttccattatcctttctgttacaccacagtctctgtaaatgtttactgtgtgtataaacagtaagcacttacacagtctctgggttgtcctggggcttcagcctgctgaatcattttatcatctgttctcccctccccccaacacacacacacacacacacccatccaataaccacatactgagtgcttatcaagcgccagtgtaaggacctcaggatacggttgggaaagatgcaggctcttggctccgaaatcaaagtgtgccctctagtgggcaaaggtgagtatgtgtctccgtgtgtgtttgtgtgtgtgaaatgcatagatcagagtatcagaaagttcacagaaatgggattaagtttattgggggtgcaaaacttgaaacccatgcatatgtgtggtcttaagagtttatgggaaatgtgtattatgaaaaagtgatgcgtggatttaaaaattttctgtaccaaaatgaacttatcttgtctattgttgtttaaattatttatttatgtactttaattttatttggaagggaaacagctagagagggagagagaatcttccatctgttggtgtactctacaaatgcctgcaacagccaagtctgggccaggacaaaaggaggaggctgagattcaatcagggtctcccatgtgagtgacaaagacccaagtactcaaaccatcatctgctgcctcccagggtatgtattaggaggagcaggacaggaagcagaggagtctgatgtaagtcaaagcaggcagtctgaaataggtcgcaggtgacccaagtggcatcttaactactgtgcccaatgcccaaacaaagtaacctgttattttccataaatctactgaattactttcatctatgagagagagacagtggagagaggagagagatattatatataaaatacatgtgctatacaagttgtatgttatgtaggtatatgatatatagatgggtatgacatctatatttttatatttgtttgaaaagtagcaccatagggttggcattgtggtgtagcatgtaaagctgctgcctgcagtgctggcatcctatatgggcgctggcttgagtccaagatgctccacttctgatccagctctctgttatggcctgggaaaggaacagaagatggcccaagtccttggacccctgcatccacatgggagacccggaagaagcttctggttcctggtttcagatcagcccagctctagttgtaacagtcatttggggagtgaaccagcagatggaagactctctctctctctttttctctctttctctctctctttctgcctctctgtaactctgcctttcaaatcaataaataaatcttaaagaaaaagagaagtagcactgtcatttcatgagatgtgagctgagtattagtaaatgagtgcaagtcagccaggtgtagctgagggcgtttgagggaagaggcattgccaagatgaccccctaggctaaggcaccagcgcttgccaaggcagaaagccacaacagaacatgacgcattagggagactttgagtgctggcttggtccaggtttcatcagtggggtgctggtaggggtgggtgatgctgaaggaaaagacgggatgcgttcatggaaggtacctgcgcgctgtgaggggaaggctggactgactgcaccttgaagacgatgggtgctgtcctaagatgtcaataggaaacccacagccagatttgtttctataaaaattgctctgatggctgaaagcagggagtgggagaggagtcaagaagctgttgcagcgacctcgacttgacgagtgcctgcgttgagcagctggtgttgtccacgagaaaaggcgctgagcttgagccctgtaaaggaggcagatcctgtagtagatggtggctgatgcgagatggtgggagacggaactgcttctagaagcctggcctgaatgctgcacctcattcattcctcgcgagtggctctcgcttgttggtttttttaatgtatcatctgagtgaaacagacacttgtaaggcactggtgtcagatgtgatggtgtttaactagaagagcactttaaatcagcttttgtctgttatgtgtaaagtctccagatggaattggattgggttcagcagataggtagtcagctgaaagatgtggaattaggggttcatctggatccaaggagtctgcaactccttcaactggaacgccaacccaattcaggtgtaacccatgtgtatataatgtacacttaacctgggaggcagcaagagatggctcgagttctcgggtccctgccacccatgggggagcccagactgagttcctgggttcctgacttctgcctggctcagctcctggcagttacgtgtatttgtggagtgaaccaacagatagaggacctctctctctctctccccacccccccaatacatttttacctttcaaataaaattaaattcatgtatgaactatgaacccagaactagtgctttttcagagaaatcggtgatccttaccgaaaacaattcagaattaaagtgaccacaaaagtggagttttaatttgaagagaaattgtttcctttcaaggctcattaggaaagaagagatcagaaatcccacaagaacacaaaatgtgtttctgaatcggtgtgtggagacatctaaaaggctaaatgagtccaaagtggcctttttaacagattctttacaaaacagcatgttgagcggatcgcctcggcttgtgcccttgtgctggatggtgctgcacagcagagatgaatacgtgagttttctatgctttactgtttcagaattggcagcttttaaagtgaaaaactaggatctttgttcgtgtttgttcttaagctgtgtgtctgctggttgatcacgtgtgctgtctttactagaagttttgaggtcacaaaaccagaaatcccacccaagagtagaaatgcacagtgaaaataaattgtttgatgcagatcatccatgaaagtaaaaaacagaaagaacaaaaaactcacttttacctttatagtttccttatgatctttttatttgtggctcagccagctgctgggctccccaggaaccttacatgtaccttgctgtgagcttctagcttcagtgttgagtctctggatttggggtctgggcaggtggtcatggtgaggtctgcagacttgtgtgtttccatggtgctggggctccagccactggatgggaccaggcccagacccagtgtgaccctgtaagtcttccctgcacaattctgcatcccggatatgttggagaggccgttcctccaggcagtgtcttcacatctgcctgtcctctagcctctgtcctagactttgaacctgctgtgtgagtcgagttcccagatgggtcctgcccttcagagccatcctggacaccacgtgggtgctcaagactcaggacaaatggatggggagctctggggacagcacctgtgtctagtacctcagaggcttgtttagagtaaggctggctgaagcccttttaaattggttttggtattctcaaaagaaaaagatgacttaagatgatggataactttgttttccataagctagattcattaaaagtgaatattaggtaaatgtaaatggaatgaatgtttataaatgaactctttggagtttcaaaaaattttttttttaagatttatttatttatttgagaagcagagttacagacatagagagggagagacagagaggtcttctatccgctggttcactctccaaatggtcactattgctagagctggcctgatctgaaggcaggagccaggagcttcttccagttctcccacacgggtgcaggggcgcaagtacttgggccatcttccgctgcttttccaggccatttgtggggagctgtattggaaatggagcagccaggactcaaactggcatccatatggaatgctggtgccacagatggaggcttaacctactacaccacagtgccagccccccaaaatctttttaaaaattttaaattgaaaattttagagatttatttcttcacttgaaaagcagagttacagagaaagagcgagatcttccattgagtggctcattccccagatagctgcaatggccagggctggaccaggccgaagccaggagccaggagcttcttctgggtctcccacgtgggtacagaggtccaaggacctgggccaccctctgctgctttcccaggtgcattatcaaggagctggataggaagtagagcagttgggactcaaaccagcacccatatgggatgccgactctgcagatggaggcttaacccactgccccacagtgccagcccctaagttgaaatttagtaataaatactcagatgtctgggttatttccaaataacttaaaatattaaaacactaagtataaagtgtaagtttaaagtttatatactttggcatcatttatttatttattttgacaggcagagttagacagtgagagagagagagacagagagaaaggtcttccttccgttggttcaccccccaaatggccactatggccggcgcgctgcgccgatccgaagccaggagccaggtgcttctcctggtctcccatgtgggtgcagggcccaagcacttggaccatcctccactgccttcccgggccacagcagagagctggactggaagaggagcaaccaggacagaatctggtgcctcaactgggactagaacctggggtaccagcgccgcaggcagaggattagcctagtgagccgcagcgccagccaactttggcatcttttaaaaacagatttatttatttatttatttgaaaggcaaaatcgcagagaggaagagggagggagagagatctgtctgctggttcacctcccaaaaggctgacatagtgctggaccaaagccaggagccaagaactgtatccaggcctcccgcttgggtggtagggactcaagtacttcagccatcgttgctgcttcacagacacattagcagagagctggaccagaagtggagcagctgggactcaaaccagtgctctgatagaagatgagaccgtttcaagcatcaggcttaacctgccatgccagagtgcctaccccaacaccttttttttgttgttgtttttaagctttgtttatttatttgaaccactgaatgacagagaaaggaagaggaagaaggagggagggagggaaggagcaggggtgggggttggagaagcagagagacagagagacagagaatgaatcttccattactggctcactccccaaatgcctgcaacaactgggtatgggccaggctgaagccaggagcctggaactcatccattcatgtctcccacaagcctggcaggaatccaggtatttgggtcatcattttgtgcctccaagggtgtgcattagtaggaaactagatcagaagtggagtagcagggactcggatatggatgccagcgttccaagaagcaactgaacttgctgagccacaacactggccccagctttgaatgacttcaactaaaatgcctgaaaggaacaacttaagaggaagagtttcacaacccaagactgagtgcccccatggtttagacatctgatgaggctggaggacagcacagcaatgttcacacagtgaaccaggaagcagagagacaggaaactggctcagcttgtgcaaccaactttcttttattttttattttctttctttctttttaaagattgtatttatttatttgagaggtagagttacaaagagagggagatacagagagagagaggttctccctccactggttcactctccaaatggctgcaatggccacagcagggccaatccaaagccaggagccaggagtttcttctgggtctcccatgtgggtgcaagagcccaagcacttgggccatcttccactgctttcacaggtgcattagcagggagttggatgggaagaggagcagcctggacacaaactggtacccatatggaatgccagcaccgcaggtggaggcttaacctgtgagaaccaccaccttccgagggcaagtccccactggcctcaagacctcccactgggccaattcccagatgtcctcatcagatcaagtgtctgtccttaatccattaattaatccatgttaaaataaaacttgtaatttagacatttgcatgaatctagggaactaaatcctgttcaaactataacagttactaagagctaaaagttctaagtaatatgtggtaactaaaactagagctaataagggaactaaggagtgtaagatgtgtttttgatgaggaacattcaaaggaagttatgaggatatgtgttttctgttgttaagagaaggagtaggggtagacacctgatgtggttaagatgccaattgtggcacctgcatcctttatcagtcctgcattcgagtcccacctttgcactctgggaggcagcagtgatggtgcaagtagttcagtctctgctgtctacatcggagaatcagattgaattgctgggtcatggcttcagcctggctgaactctggctgttgcaggcatttggagagtgaatcagaagatgggtgatctctttctctctgtctgtctctcttctcctgcctctcaaaaaaattaaatacataaatatgtattttttcaatgaaactaaaaagagtaatgttttttcccatttggagattgtttctgaatgagtgaacaaaagaactgattggataaaactgaaattgttaagatttacaatttgaatgaactctataagattgcaaagtcaaattacgtatgatgatgatgatgattattttttttttgacaggcagagttagacagtgagagagcagagaaaaaggtcttccttctgttggttcacccccgaatggctgctatggccggtgcgctgcgccaatccaacccaggagccaggtgcttcctcctggtctcccatgtgggtgcagggaccaagcacttgggccatcctccactgccttcccaggccacagtagagagctggactggaagaggagcaaccaggacagaactggcgccccaactgggactagaacccggggtgccggcgccacaggtggaggattagcctagtgagcctcggtgccggcttaagtttcccctctcttaacacctcaccatggggattaaatttcaacacactcaaactatacctctacccggtccttccggagtccttaaagcttccattgttaaaagttctgcattctggggcctatgttgtggcactgtgtgttaagccaccgactgtgatgtggggatcccagatgagcatcagttccagtcccggctgctccatttctaatccagctccctgctaatgcacctgggaaagcagtggaagatgggccaagtacttggatccctgccacccacatgggagacctggatggagttccagggctcctggcttcagactggccctgtcctagctgttgcatccatttggaaggtgaaccagtggatggaagatcactctttctttctctctcctctctctgtaactctggctttcaaatatataaataaatctaaaaaacaatccttattccatgactcatcatggagaagagacagtgatgtagattatagattattattctgaaaaggctgggatgctttatgacaggagcttgttaaatccataatcctgggaagacaagtaaaacacaggcacatttctgccacctgatgggccatctgaaggtttatagagggatgtcattcaattgccatttcaatgtatgttttctgtttgcacagaagctttctgatcagaaagcctgattttatagtagcaggtaaaaagttagtagaaaatgtgttttcctcatgagacattcctggaaaatctcctgcaatagagggacatttctcatttttctggacaggttgtgaaacagttaaataagatgttccgaacacaatggcatcaggcaaagccaaccggatcaaatagattgactttgtcagaggtattgcagattgaaggcaatcagacccatgcctcctggaaaactgaagtcgatccattatgaattagtcactggaaggctatgcccctaataatagaacttcatgtgctttccgctttcctaaactccaatatgactaaatactgcaaggctttaatgtgttatgccaacgtgtgtcacagtgtgttttcttctggtgaaagaagcttttcatgatccattgactgaggaaaatgaaatcctgcacaatctagatgccagagattgggtctccaggaaatgctatcacatcagagaaagactgtccttgaacctcccaggagggggtggtgccaagttcttctcgccacctacattgcagcagaactttgggacgtcagaccttgaatgcgtatcttacagttccaaagggcatctctaggcccttggaattgcacactcattggaaaccttaaggtgacactaaccagggaagtttttccccagaagcagatggtatcctacatgggcggcatggatccggacttctctgctgtcataaaactcttacttaatttgtctgtgcttatgccttcctctttcacctggtaggataatcctgtgattaggatgtcacaatcagttagcttctgtgggtagcttggcagagtgctggttctgtcatgccaaacatgactgagggagttcttcagtccacctagtggcaaattttaacaacaaccctagtgcaactgttcaaattgtacaagtagtcccctttatggagttagacttcttcttcttcctcttctttttttttaagatacagagagaaagagagggagagggagagggagagggagagggagagggagagggagagggagagagatgtcttccagccactgattcactccccaaagggctgcaacggccagggctgggtaaggctgaaagcagaaaccaggagtctcccacgtgggtgcacacgtaccaaaaggagggctgtgagctacaggtgaccaaaacctacaggtgaccagaaccaaagctgtgctccttcttctgactccctactcctggaaccagagcgtggaatatgagtgaaacagaagggccagaaatctttaggaggcagggggcctgaaattacaacacccactgactggcctcttcctccttcggtcccacatggtctggctgcaggccccagcaatctgataatgccctgtgaacgtgtccaactcctgacttctctttcctgatcctataaatctttccccagaccccaatcagtctccatacttgcctgttgtgcatatgaagcctttcttttcccaaaagatcattctatagattgggtttggaatgcaatgaatagcaaacctactcgataaagaaagaaccaggagtgggtatttggcacagcaattgggatgcctgcatccataatagagtcctggctcctctgcttctgatccagtgtcgtgcttatacactccctgggaagcaataggtaatgactcaaatatctgtgtctgtgccacttacctgggaaaccctgatgcagtttcaggctcctggcttcagccaggcccagccctggctgttccaggtatttggtgagtgaaccagtggatggaagctctccctctgtttctctgtgtctttcaaataaaagtgaaaatatgtaattatatataaaaaaaattccttcaaagacagaaaaggaagagaccagttcctgggataaattcccataagtaccagcagcaaagttaggtggcaggtagaatgtgtctcccagaccagagctaacagagtatttataattctggggtgggagcaggggtggggggataggaaagcactgtaacctcatctgggtatagataatagggggaggataatgtgaagggggcaaagttttggggtaggggaatggtctataagaagtactttctgctttttgactggttgcagttttaagcaggattcaatgctgggttttgagtacaggattttatcaaatgcttaggaatgtggaacaggtttttcattttgaaatccgttattagtttggcccagggctgttagctgagtttcctctcttatttcttctccccttcctccatccttcagcctgtaactaagttcagaacatctcagatttttgtttaaaagatttactttatttattttaaaggcggagtgacagacagagggggagagacagagaaagagaccttccatccactggttcactcctcaaatggccacatggccagggcttggccaggctaaagatgggagccaggaacaccatccaggtctcccatgtaggtgggcggggcgcaaatgctttggtcatcatctactgttggaacagaagctgagcagctgggactcaaactagtgctcccatctgtgatgctggcggcatcacaagctgtggcttaacctgctgtgccacaacaccggccctgtaagttttctgttatcaaaaaggtcttgactcatctttaacaaaattgtccatgaagaaccctgcacagaggaggaggagggagggtatcaaaattgaggtctgggagagttctgattttctaaacaatggaaggaaaatgccatgggacaatcagcgacttgttgtgtttttattttcccagaaacaataagagtgatgctcttctgaaacttcctttcccacgaatactactgtgtgtgaggccccatccaaatgatgttcgagacttgcccagacttttttttcctttctctttttttgcccagcttttctaatggggagagcaaaggtagctgacctcaggtagcttctctcctgcttgaacctgctcaagcgtgagatggctccaggctcagcagcctcaccagcctcaccagcctcaccagcctcaccagcagcccttccctgccaagccagtgccggccctgacgtcagggagagcggtaaggagacggttgccgtgagagacgtcagaatgccatacacagcatccagtagtgaccacggagtgcttgaggcagagctcactgctccagagatgcagaagagacatctgggaaggagctatctcagtccattgaaaaaacccacatagtttcttgataaaattattcaatgcttaaactgcttgcaagctaatgaaagagggaggttattcaataccttgaatgaggtggaggagaggaactggaggatgaggggaataagccaagggctgctgccctgcactcattgattgaaagggctgggatccagtcagggcaagaaaggcaagttttctgcttgtgttttagaaaggagggacaggcaacagagaaaaggattgcataatacgatgatggcagagcacaagaggatgaaatgatgggagtgagggagacactcgggcagcggcagctgagtcaccaatcagggcagacctcggggtagcagagacctgaagggggcaagcgagccttgtgaaggtccgaggctaaagtgtgtagtcctgcattttcttcctctcacattctttttggaggacttgatacctagtcagttaggcagatactgctcaagcctgaatgaagacagaggctcctggggaacagtgcaggccctgaggccagagctgatccctccaacagtgtggaaaggactgactcccttcctgtcctcaactcctacccctgtcagactaccagaactctatcctcctcctcctctctcctggatctgaagagagggaagaaattggttgaactgaaggacagttccaagaagaggtgggcacccaagggtgctatggggagcaaggaactgccaacatgggtggtggtgttagaaggtggggagttccttggtggtagcataggtctggagaaggctaatcgtgtagaagctctggtgttgatgaaacagttgaaacaaactgcagagggagatgacctgcccaggaatccctgcagagcaggggtggggtgcatctggctcctgaactcacgtggtctggccctgcctaggcaaccacaggcaggactcaaaattcaatcatctgtaacaggctaatttttaatttttaaatcaatagttttgcatggcctgtgaatgctgttcaatacccaaatggctatgggcaaaaaaaatgttccccacccctgccccagagattctttaaggcagtacttctcagtcttgacacttctgaccctaggggtagtagactctttgggcctaggatgctcagtagcatctgtggcctctctctcttagatgccactaaccttctcttaaacttgacaataaaaatgtcctcagacattgacaaacatctccatgaaaggaggagccagtcactccacaatgacaaccactgctgtaaaaatttgaaaaggcagcctgattcataagcaaggaatagtgttgtagagcagcaaacgattgttggatactcagaaccatgtggtcttggtcaaccagcagaagaacttggttttggttaatggactgcactatgctgcctgtcttccagtattaaatgcacagcaatgtggtaacactgatgacacattttgaccactagaccaccacaaataaagacctatccttttccaaggacttaactcttcattaaagttattagtagataatagacttgccctcatagaaatgggagaaagcaatgcaggccacaggctgaggctccaaaggaccaggctaagtgtgtgagagtggagggaggatgggagaatgagtagctgtttttcaatgagtgcagctaccgaacataaacaaggcattccaaacccaagcaccaggtatccctgagccagtgtcacggcaatctctggcgggatcctcagacccattccagcatctgctttgtagcgctgtacagtcttccctgggaatcatcttctaaatgaatacatgtcaaagaaatctagaggaagaaggcagagggaatggagggaagtgggaagggagagtttttcctgcttcactgaaacccaggcaagcagagaatggtggctgtgtacttccctggcggtgctcacatcctggcattaagggaagtgctatggagccccagtgcagaccagaccacactaagcccttgcaggcccaggccctccctctcaccaccagcaatagtactggatggtgggctctgccccctgggaaatttcatcctgtaaaacccttactgaaggtttgcgtcccagcttcactcacaagcgatgagactgtggataagtgggggcttctttcatgtctcatttgtacagtggggataataattcccacttcttagcattgttcagattaaatgtgataacattcgcgaagcatttagcatggtacctggcacaagtttcaataattatgcaaatgaaaagtaccacaggtgtatgatgcttaaactattcaaggatcagcacagtcttcagctctgctgttttctggaaaaaaaatttttttttttaatttgagagacagagagagaaaagatcacttctatgtgttggttcactccccagtacctacaatggccaggactgtgctgggccaaagctgggagccaagaactcaatccaggtctcctacatggttgccaggaactcaagtccttgagccattaccactgcctcctagggcctagattagcagaaggctggagtcaggagctgggaccaggactggcattgtggttcagtgggttaagctgttgcctatgacgtcagatcccataagcactggttcaagtcccagctgctccatttatgttccaattccctgctaatgaacccaagaaagcagtgggagatctagatggagtttctggctcctggctttggcctggcccagccctgaccatcacagccatttggggagtgaaccagtggatggaagatctccacacacctccttcaacacccagtctctctgtgtcactctgccttacaaataaatacaataaatctttttaaaaataggaagtggatccagatgtcaaaactaggtactctaatatgggatgaaggtacctcaacctgccatcttaactgttggctaaacgcctgcccctctgctatggtttgactgtgtccctcaagtgttgaaatttaatccccattgtgaggcagtaacagggtaagaacaatccaaggatggtgatgagaggtgggatctctgggaggtaattaggattaggtaagggcatcagaggagagcctccatacgaataccattggccacataagaagacagagaacagtggatacagatacactggtgtgctccccatctcttgccaggtgatgtcctttgccacctcatgcaaagaacttcatcagatatggtctctcggttttggacttccagagccatgagtcaaataaacctctttataaagttactcagcctctggtgtttcagactaatacaagcctgaagaatcaccggtgggatttcagaatggtcatgagagttactgggcatcattagtagacttaagacaaaggattatcaaaaggtgagtaggaatgaagaaatgggtgcaagataggaggaaagagtaaacggagacacacagacaggcagacttttgtagaacactgctcacttcaagatgttaatttagccaggtgctatccactccacttggacttttgaggcagtccagtgaacccagcaagacggactacgacagagaaggtacagctgagagccagaacagcagccagtccaactaggagtggtgatctgggttgcagaataacaagtatcaaggagtcctgaagaacatgggagagttagaaaggtagtgtgtgcaaagacacggaggcaagagtgtgtgtgcagggagtggacttccttggggctgaaggtggagtatggggttgaggtgaagtctgttactcagcaatgttttaggtatttgctgaggattacctacacgtcaggtgcagtttcaggaatggagattctgtaggggaaggaacaaagcccctcttctcagacatagacagcttttaaggtggttcaaagaccctaaagctggaggggtatagggaagactggccaacacttgctcagcagaccttctggtagtgggtgctaaagagcctgaacaggggaaagactgaccccaaggagatgaaaaaaaaagtcataaatttgcttaccgtggccttcaactttgtaaaccaacaaatccaggaatccagatgttttgttctgcatcttagccagaacctgtgctaatttctgaattcaaatatccccctcaaacaagtttcttcctacagatcaaggaggaggtccagggatgacagccttaggggcacagcacagtaaataaagtctaggtgatgatgggtggtgacagcggttcagccaggtccttgcacaggttaagcctctgcctgtggccccggcatcccatatggttgcaggttcgtgccctggatgtgcctcttctgatccagctctctgatccggcctgggaaagctgtagaagatggcccaagtgcttgggccccgcacccgcgtgggagaccccaaagaagctcctgattcctggcttcagattagctcagctctggccattggggccatttggggagtgaaccatcggatggaagacatctctctctgtatctccctctgattgtatctctgcctctcaaatcaataaacactaaaaaacaaacaaacaaacaaaaacccaaaaactcactacatttggaaaaaaaagaagagagagaaggctgagaatgggtttgaagatgagttcatgagcagacagaagggatcccacgaacatggacaggaaactcaaaaggccacgtgcttttatggaaatccaagtgatgggtaaagatagggccggcactcgtcggctgtaagatgcggtaagaatccctcatcccttatcatttaaaacaccaagaaaccttaaagacagactaaaaaaatttctgtcaacacagagtgaaagttctcgtcggtcaccagggactatcccacgtctccagagggcagattcgtcttcgcggaagcaggcccagtttcgccgaagcaagtcactcgacaccaccaagtgcacaacgtccagggtagggcatactgaatttgaggtcctgagtctgcgggttctaccatgaacaacagcgggaccccggagtggcaagtgcgtttcctcgggcgtaatctagagcagccacccctaaccgaaggtcgcgacgtccacattaagacactgctgaggggtttttgtcccccccatgttctcactggtggggaaaacaacaggggcaggcttgaggtctctttcacggttgcatggacggacagaaaacccttgggattcatctaacgaaaaggcgaacacaactccccagggtatcccagcccctggctctctcagacctcaacgacagatgcgccgaaacccgtcactggcgatttgcacacccggttgcggtgcattgtggggttggtagtccaggctggggcacgactacaggccgacgaagccacagaactacatttcccagtaagccccgcgagctgcgtgccgtgtgcgtgtgacacgagacttccggacgagccaggggcggggccgcggcggaggcaggggtgaggcgtcggcatgcagcgccccgggcccttcagcaccctctacgggcgggtcctggccccgctgcccgggcgggccgggggcgcggcctccggcggaggcgggaatagctggggcctcttgggctcccacgtgcagccgccggggcgtgcacagtctgggacccgcggcgccaccggcaccgccagcaccagcggcctggacgccaacaacgtctgcccggccccctccgcgatgtccaaggccgaggaagccaagaagctggcgggtcgcgccgcggtggagaaccacgtgagggtgagcagttcagggcgtctgtcttaagcgtggagagctcgtgccattgcctgggcgcggctggttcctggcaaggcaaggggccgcgcgaggcgggagagggcgtgcactttacccgagtttgggagcctgttctccgctccttcaaagcttgttgggcgtggaattgcctaggggagagtcccttaaaaattgagctttccgaagactgctcgtccagctggaagcgtttgcaaagtggagcgtggcggtgtcgggtgtttggagtggggacttggaggcacctgccgcctggcctccatatccagcaccctgggctgtctccaggtccttgcctctcactgtcccgggaagcgcgcgctcgccgcgttttggagggaaagggagaccgagccgaaggcggaaaccaggaactttaaacctcctccctttgacagggccgagtggaccctttggaagcttggcggatcctgtccttaagggagggctgcgaagatggtcacctgtcaccccagtgaggacgtggccccgcttgtgtgttaagtggcaggtgtggggctatcgtagtggagccttttaacccatgtgggtttgctgtcaccgtccggttaattatcttaatggtagggctttgtgtgtggctgagtggagtatttctgccccatggtggagtttctttggccttgttggcgttctctcttttctgttacttagaaagtggtgtcaggttcccttttccttctgatcacagtttttcacattggttaatgctttcctgtgcagaaggattttgcacagtgatgtcttctgagcttcactacagggaccagtgtgataacctggggctcagtgtgttttgtagaagggatggccaaaccaggtcactcctgttccagagcccttccacctgttccactgctgacctgttctactgtggcttgttgcaagtctggttagcagtagaattttctatggcagttaacagagactttgggctctgtatttgggattccattcctcagctgtaaaattggcacagtaagctgaacattcaaaatacctgcataagtgagtagttaatagcaggacaaatgaagtctttatggttagaacagacccatccatttttttttctgttaaacttttttgttgttgttgttgagacctatgtatttaaaaggcagagagagggatattttccatctgctggtttactctccaaatgtctgcaatagctgaccaagatgaatccaggaaccagggactacaaccaggtcttccttgagggtggtggggacccaatcacttgaaccatcttccagtactttcccaagctattagcaaggagctgtaacggaaatggagcagccgggactcaaaccttccctcgcaggggacgcaggtggtggcttagcctgctactgcaccacaatgctgaccccaacaactccatatctatgttgtcctgtagtgagtgcattcaattttggaggcacgtgtcttcctgactttttgtttttcagatttatttatttgaaagagcttcagagagagggggatgagacagacagacagacggacagacatagcttccatccgctggttcattccctagatggccagggctgagctaggtaggagccaggagcttcatccaggtctcccacgtgggtggtaggagcccaaacacttggaccttcctccgctgcttttcacaggccattagcagggagctggatcagaagtggaacagctgggactcaaactagttccagatatggctttacctgctgtgccacaatgctgcccgccccgacttttcttttacagttcagtgtttcgttaaataacagcgtgcaagtccacactgcaggcctgagaccccacacactagattcaggccggatcattccatgaagttaccaggtggtcgtaggagatctccattagcctttggagggcacctgttaccatcccatttgtcctgcagagcttggtttagaggccgttgcttcctttcagtctttccctggcttcctgaggaaagcaagatttctctacttctgtattctgtagcactttgtacttcttagatgctttctcttggcctcgtgttctaatcatctctgtgtttgtctccccagtctcctaaagagtaaactcctggccggtaattaaccttatcttccttccgggctggccttggtggagcctccctggtaaatgtttactgaattttgtggagcgtggacacagatatggaggttgcaagttactggtggccctttgcttagaatctttggggtgaagagtttccagtctcctagcgcgttggtgttgtgctgcttccacatctgggtaggtggaggacttggagaggtcgcagctaaatcctgtgtatagccaccctgggctcggatccctgggctcagaactgcctctttccagggttagggccacccagggtgagttaacatgcaggactgtctctcctgcaggtctgtccctcatccctgtgttctctttggagcctgggctttgttttttggcttgcttatcttgaagaagctgagggacagtagttccaagtggtcagcagaagttcaagtttgctgtattggataaggtgagtgaatattggatggtggacacatgacacgtggtgtagtattacccattagaagggccttctgctgtttgccacctctggtttgctttggctggggcactgattcctggacagtcatttgattcccaggcagcaagagcacatggttgaagagcttggagtttggcaggtccctgtaatttctgacctcttccagaagccacaggaggagcccttctcggaggtcgtcagattcacctgagttcaactttgtgttgcctgcttattgggcgtctgtgagtgacttgggtgtgtggctgaacttgatcatgaggaatcctgcacttgaattacagcatagctggagtgctcatcttcaggccaagtgtaaaggtcaggttaagcctatctaagcatggctgttaaaacattttcttggcgttgggatgcaatgggttaagctgctgcctggctgttccacttccaatctagttctctgctaatggcctgggagagcagtagaagatagcccccgcgtccttgggcccctgcacccatgtgggagagctgtttctccctctttctaactcagcttttcaaataaataaatcttttcttcaaaaggacgttttctcattgcttgcagatgtctgttgaaagatttagacattctgaatgtttctgtgttgcgctgtgccattcacttgcctttgggggccgcccaggcagccaagtgctttcattgcattgccttctcaagggtactgctgcaggtggaattctgacctaatgcaagctctgctgtggtggccaaagccctctggtatttttggtgactggaactgtgagctagtcaaggggctttctaccaggtaaaagatacagaaatggatggataaagtcttctgtaaatgaaagaggcccacctacaagcatctttagtatacaagcatgaagttgtgggtttaggcaatatatatatatttttttttgtaactgtctttacctattggtaattctttctaatcttttctggtagtttaactttgagaatgaccatgaccatgacacgtaatgacataacacagaggctgaccttgggtattcctgtggcttttgtcctgtaggcagtgggttttagctgtggccctcaatttgtccctaggggcctttgaggcttctcttcctcctacaaagaaagtttcactttgggctttcctttgccaagtggattattaatgagttcttgaaacttaagaactttgaaatatttcagcaaattaaacttcctgaaattgcatattcaaagtgaggttgtgtagggggagagattggtattgttaaaagagggtttgttttaaaaaaggtaaaatcatgatacagatataaaatgaatatgtcaaacactttattaaatattaagggaactggaaaaggtgttagaacctgttcacacttgcgtaagtctgttttgtgctgctgtaacagaataccggagactgggtgccttttacagtgaacagaagttgatcggcacacagtcttagaggctgggaagtccactctcaaggtgctcacatctgagagagggagggagagattggtgccatgggtgggcccccatcccacccatgcatgaggccagagctgctagaggtttcacctcttagtcctgcttaacaacaattaaattttagcctaagttttggaggtgacagacattcaaaacataccaacagaagtccatacattcatatgcagtcaaaaatgttaagatgaatttacaagatctgtttctaggatagtaatcaattgcatctcagttaatttgtatttctgtgggcaagaattctttgctttgttaacagttttctataagttacagtctgtctctacagagctgttagatagcctagtcaaagacaaagctaccccttgtggggttaggtcagataagcaggttccagcattccactgaaaggatacccagtaatctcttttgttcttttcagagtcctaatgtttttccatcagtgttgaattaatctccagagtgggggaaaacgggtctctaactcaaggcttgttgtgagatttgactcgacatttatgtcttcttggtatgggctaagtgaatgatagctgttactttggttttcagttgttttatctcagatttgcaggaaactgatcccaggaaatagagctgagctgagcgctccattagttcttgtctgttttgttggttgtagtctgactgctcataggtccgtcccctttcatgaaggtagccttggcactgtgacgctttcttgtcttttgcacccaggaggcacttctctatctgttagagatcctatcttttttttacaggtgatgactgtttctcacgctcttaaccaagccattttgtctggttgaatgtaaggaggaagtgatgacattggcgatgtcaggagcgaaaggaaggggccagcactgtggcttagctggttcagctgctgcctgcagtgccagcatcacatacaggcgcgggttggaatcctggctgttccacttccgatccagctccttgccaatgcacctgggaaagcagtagaagatagcccaagtctttgggcccctgcacccatttgagagatctagaagaagctcctggctcctggcttcggatcaacccaactccagctgttgaggctatttggggagtgaaccagcggatggaagttttctctctgtctctccttatctctctctgtaactctgcctttcaaataagtaaataaatgtttttaaaaaaaatgaaaggaaggctttgctgattaattgcccctgatcactaggatgaagtacagcactgagattgagatgtgatgtttctgtcagctaccttgcacctgtgttggtgaattgccgtttataattttatagctttaggaagtgagttgaagaggacgtaaaatgtgacattaataaattttgctttttcttccctttttttggcagaataaccaagtgctgggaattggaagtggttctacaattgtccatgctgtgcagcgaataggtacgttctgactgtctactggatgttttatgtgattatgggggtgcggtaaaggaagtggggcacccgttttgcacttgttaattgtggctgcagcagtgccaagctggggagaaggacctgcctgcctgtcagtagagcgttgctgcccttctcaggagagggagtcttccatccctcctgtcagttctgggaggtgcccttgcctttgtttactctgctcagctggtggggaggagctgacttagcaggagttccctagggagctttaatcatcatgatgacatcagaggtcctgtgtggtctcaggcttcctctgaagcccttgggtttctcatgcaaacaaatccgaggccaaagtgaacattcccttcccttgagcctagagaggacctgggcctcttgcagttggtagctggttcctgaaggtgctgacttcactcagattgcattgtctctgtgcttaggaaagactgggcacttatcagtccctgtggctgtttaacaggttttactgccctgctttttgttcctcataacaaagcccagaagagaggcttgcctgaatgaatggggatctgtcttctaggtgcctcgggcagagcccagaaggcaaagtccaggaatactttgtcattaaggaggacctgtagtgccagtgtgatggcttctggaagccttctcattggtcagacagtgtgcttttctaccttaaccagttatgcgaagaattttaaggcccagaagttgctgtgggttttataatagtgacatttaagccttccaggatgtagactctgattaggaagacttggaattttataagatttgttttcttggattttttttaataaaactttcctaaaaggtaacaatttcaaaatgagtaaaataaatcccctataaccatcctctggggcatatagatgattatattttttcctgaaggcaaaacttaaactcccctgggcagggcagtagagggtagcagtgaaggctgaagagctaggctgcctgggatcctgccccagctctgccgctaaggctgtgtgattaccgagctgctcgaccttctgttcctcagtctcctcatcacgaaatggagaaagagttgtaactcaccttctgggctgttagacttcaaacaggtcattcatacaaagttcttaggatgttgtcatgcatgtaacgacaatgaacactggttagtgctcccctcactcactaggcttctgatgtctgaaagggtggtcaccgctgttacaccaaggacaaggacacagagtggaaggcagctgtcagtgggagacagaccttgtcctttctactgggtttgagcaaatataccagtgacaagaaaaaaagtgaggagagttgcagattggtgcctcctcacggggcaccaaaatgttaggaaaagaggcgcagaatagagtaggcagtgtatgaatttacagtcagaccggatttattcagagaaaacaaatctgtagagggaggtgaccaactgcctgcgtgtacaagatggagcctgtggcagaaggccttgactcccaggggcctgatcttaaggaaggctaggctggggttggagtagggggcagcagggggaggggaattccaggaactgggtgggtgggggggccttgggaacctggaaaagaatgcagggtggggtgtaaaagcaatagggtgtgagacccaattgagattcaagggcaaggaatacatctcaaagtttatctcctctgggcagtgagggagaatggctgagccttgtgttcttgttccatcagatacgcttttgtctccacagctgaaagagtgaaacaggagaatctgaaccttgtctgcatccccacttccttccaggtttgtcgttgctttccattctgcatctgaacagctgctgccaggtcctctggctctatggaggtgggcctgtgggcaggaaggagtacccacaggagcttctgttcacttgtgaatatttcagggcagcttgagttcaggcaccgggaagcatgcagatgggacctctgtcctcaaggagtattatccccatttacaggtggaaaaaaggcggaaaggaattaattgatgtgttagtaatacaaacacagtattttggttccatatctaatgtactttcagcatgaaattgtaggagctggtagaggagaatagtagagccaagtaattacagggaaaggtaaggaaagaatagactttgggaggtagaagggaaaagaggtgctaagttggaggcctgtcttgtctctcttctggccgttgagaaggggtgtgtgtgtacatatacatatatataatctcattggattagccaaggtgaaatttactaactagaaaagtgggttggatttacaggtagctagtgctttgggacttcatgaacttagctttggacaacccagacagcctggttttcctagaaaagcctgaagcagttctggttaaggagagactgggtagcattcttctgagccatgtgggaggtgcagtcagacaaaacagagggtgtaggcagggattccaggtagtcaggctaaggaattagacatgcatactaagtatgtccatctaaaggggttgagggtgagggtagtgtgctatttttaaataaaaagacttgagctatttgattctttagtctgagtgtgtgtgtccctgttgtgagcaccacttgtcacacagcttgacaaggctaatgcagtgtgtcggagcacggggaagaatcatacagaattgtgatagtcttttcagtaccactcaatatatattcagtgcacacatccaaagatcaataccactcaatatgtcattagtccacaggtaatagtaataagtataacacatacaaagcataaaggcataaccaatctaagcactcatggctaaggatgtaatacgaatgctgcattctcaaggtttgtatcatggtcacgaaaagtcaaagtccagagtccaaacggatctcagaacagtcacttacgggcaggagtcaagggatggctggcactctgggcagtaggctcgaagttccaagacggatggcaaggagaagggttggagaggtcacctgatgagaggtctggtccggctccgatgtcagctctggcagtagctgggacgtgcaggtgagattggctccagcggagtggcgagcagcgcttcagtcagtgaacactcaggcagagtttcgctggcactgagccctggtccccgaggggatacagagcagttgggaggcttgcctttctatccccatctggggcaggtgggcggtgagtgtgctctagtgtgccaccagtcacaggctcatcttcttgggtgtcaccagccagatgttggtgtttgggtgtgaccagtggtgtgttgggggtcatcttggtgtgaccagtcgtgcagtagtgggtgaagtaatgcagtagccagctggttggctgcttcttatgatgtaatgtcctccagcccttatcaggcctcaccacctgtgtctgttctgacagatggtctgggcagttcctggtgcttggtggccttagcttaagtaaccccattttggttttgtttttttctctttctttttgagttagcagtgctctgtaactcttttgggactcttttggccacagcacagatagaccacatagtgttattaaggcaggcatgcaggataaaattgatcatatttgtgagctggaaggccacgccttcaccacacccttgtgacctcatgcctctacctggccacacctgtgtgcccacctgccaatcaggctaattaaccactcccctttggaagtggattaaagtcctgggacaaggtgggcccagccgttccttggcctttttggcccttttcccttttgcgctggacccgcttgctgcaccttcggggcgcgtggccttcgggccacccgccctatgctttctagcctgcatgctcctccacatggcaagctcctggtactcggtaagaatccagatttccctctcttttggatggggccctcactctcctatgcatttcttaaaaaaacttaccatgctgccttgttcatgtatgccagtattcagaattcttgtctattaggcaagaacccactggctgtttaaggggtatgcctctgattacatttgccaccccaaatgggattttaagggccctgtctgattacagggtgctgatttctcttcttgactgtccagtaaagtaaattttgccttgctttgcttttcttctgtttcctcttcccctcccacttcttcctccctgcctcccccccctttcctagattgcttgtaatctcttactaattcaacaccaaattcttggtcaggtgggaaaatctgtttttctggcagtggatgtctcactccatcagtttcatcacttggtgaagtcctgggtgggtggtgctgtaggctgctgtactcagctgttgtctttgggtctccttttgttatgggtgaaatgacaacagagaaaatagtactacctcagttctttgtctcacatggaagaagaatttccaagcggacaagcagagagatttaaaagtgagatttattagtcagagacctccagccagagtggcatggaggggatccaagagaggaaaaacctaaggggccggtggtactggggtttttaagcacaattatggggaagaaaaaaatttgacattcagttacagggcagggacaaaacccatcaaaagacctgatttgcaatccttcattctatcttacttgctcttgatgtgacaaaaagacccatgagaagggtgggacacttaatttgttttacagggaactgggagctcagaaggaatgccattccctttgctgttctcataagattggaagctttcaaggagtgggcaggcaggcacttttgaccttgcagatttgcaccctcagtttccactgggaccaccctgactgcctgttaacccatctgactcctcacacttccacagtttggaattttttttttttttttttttttttttaggattgatttgtttacttgaaagagttagagagagtggaggagaaacagaaagagcaaaggcgagacacagagatcttccatctgctggtccattctccagatggctacaacagctagggctgggccagctggaaccaggaatcagcagctttatccaggtcttctgcatgggtggcaggagcccaaacatttgggccattttctgctgcttttcccaggccatcagcagggagctggatctcaagggagcggcgggactctaacctatgttataggtaaaatggcagcgaagaaaggcgaccttggttcctgtctgacctggaagaagaatttccacgtggactaggcagtgagcaaagcaagatttaagttggaaacttcctgctgtagcagcctggacagggctccaggagaggcagaggaaactgatggagtattttaagtataattttttttgggaaaaaaacagcagctaacaatcagggtgggcacaaagcccatcaaaaggccagattccataaacctgtctagcttgcttatagtaaaacagaaaagccatcagaagggtaggataatctttgttttcacaataaacaaaaactcaagggtagaatcattacttccttgctattctcatgataaaactggaaactcagaggagtattttgctaacagcttctgaggaaaagcatgcattttgtaccctcttaaagagacttcccctttcctcattccagctggaacccaacctaatggcctgttagtccatctacctcctcacaccaatacccatatgggatgccaccaatgcaggtggtggctttaactgctaggccgtaacactagttctgggaaacctaattgctgtttcttggtcctgtttgctctgccacccctgactctcagtttttgtgatgggcatcctgtaggtagctagcttcctaagtgtataggatgcaggtttgacgctggatgtctgaagacctctttattctaccctttcacattcagtcatttgactttgtagtcaattctatgttaaataatttcctaggaattttgaagataatttctctttagtctggttttcaatttgctcttgagaagctcgatacattctgatttgtaatctgttctttgaaacctacttttagttttctctcagaactcatttatattctcttttgcttttcttcagtatgggtatatattttttattttaaagatttattttattttattatttgaaagtcagaattacacagagaggagagacagagagagagagagaggtcctccatccgatggttcactccccaactggccacagtggctggagctgtggcgatctgaagccaggagccaggagcttcctccgggtctcccccatgggttcaggggcccaaggacttgggccatcttctactgctttcccagaccatagcagagagctggatcaaaagaggagcagccaggactagaaccggtgcccttatgggttggtggcacttcaggccttcaggtcaggacgttaaccactgagctgtagcgccagcccccggtatgagtatattttcatctgttgtattggcatttcatcttgaaaatttacacttcagttttgagaactttttgcttttatctttggtttttcttccctctgttttctttggtttttctttctaagaccctcatggtggctttgtggactggcttagtttagctatcacactggggcagttgggaccattctgctgctgtgtaaacaagctgagactagattcctggaggaggaacggccatgagcacagtggctctaggcatgcaagtgaggccatcttacactcgccatttttacacttgccaatccagatgataagattttccaatgagtccatggaaatctgagaaatcataaatatttgctcctataagccacggagtttaggggtagctactgtgtggcaaaagctcattggagcagtaactgccttttgcccaactgtgcctggcaactcaggcctaagactggctgtttgacctacagagaaccaacctgccactttgggagtaggaaaggaagaggtggaggtgtaatagcttttaagttacttgtcactccccctcttcgcggaggaacgacacaggaccctgcgctgttcttttgtctgctcggcccttcccgggtttgccgctggttcttcccgggttggctgccatcccttccacctccgtggaagggcggctccccctgccactttccccacttccgtgggggagtggcacaccgccggccggctctctcagatgttatctggatgttccctttagatgttcctggtgcatgttgtctctctcctcctttatagtcctcttccaccaatcccaactctgctacccacacgccgagtacgctgccctcctccaatcaggagcaggatcagctcctgcaggttattggtcgaactggaggcagctgtgtagaagttgtttactcctctcccagcgccatattgtgggagagcagatgcatagaataagtcttaattccagtaacttagtctagtccgagttgctccccacagttacttttttttttttttttaaagatttatttatttgaaagtcagaattagagagagaggtcttccatccgctggttcactccccagttggctacaatggccggagattcgcctatccaaagtcaggagccaggagcttcctcctggtctcccacgcaggagcaggggcccaagcacttggaccatcttccactgctttcccaggccacagcagaggactggatcagaagtggagcagccgggacttgaactggtgcccttatggaatgctggcactgcaggcggcagctttacatgctacgccacagtgccggcccccttaagttacttttcattcagttttcctgttttactgctctgttgtatccacttcctgtagtttgtagataatcccaattcctcaatctttgggaggttctgtgatgtttgtttggttgttacttgtctttttccactattggcctaggatttctctcttatttctgccatttaccattgtctatcagtggtccagcttttagaaatttgttcgagtcctggctgctccacttccaatccagctctctgctaatgtgcctgggaaagcaatggaggatggtccaagtccttgggcccctgtcacccatgtggtagacctggatggagctcctggctttggtctggcccagccatagccattgtgaccatttgaagagtaagccagcagattgaagatttctctctctgcctctccctctctctaactctgcctttcaaataaacaaatctttttaaaaaattccttttttgtactttttaagagattttgagaaggagctaagctaaatatatgtattcaagcagctatttttaactggaagtctgatcctgtgcttttttatgataacattctcttaacttgtattatagtgatcattgataacagcagatccagactggaaagtactggccaattttagttaattaggctggaacaattattcaaagttcacaggattttttatttatttgaaaggcagttcaaataatgcccaagatagctggtgctgggccaggtcaacgccaggagctccatccagatctcccatgtgggtgacaggagcccaaacacttaggccatcttctgctgctttcccgggtacgttagcaaggagctagattggaagtggagtaactgagacttgaactggtgctcatgggatgctggtgtcgcagcttaacaccctgcaccacaatgctgactctcacaaggtttctaaaaattcatttgttcagttttcttccccctttaaattcaaacttactttcttttaagtttggtcagatgccatctttaaaatggttgaactataacaattttttttaaaagatttatttatttgaaagagttacacgaaaaggagaggcagagatagagaggtcttccatctgctggtttattccccaaatggctgcaatggccagagctgggccaatctgaagccaggagccaggagccaggagcttcttccaggtttcccatgcaggtgtagaggcccaagcatttgggccatcttctaatgttttcccaggccatagcagagagctgggttggaagtgcagcatctgatactcgaattggtgcccatatgggatgctggcattgcaggcggcagctatgccacagtactggcccctgaaccctggtttttaatacaagtaaacttataggaatttaaatgattttgaaaatgaaggatctgacctaagccccagtagcatttattattcagtcttgcttcagacccgcattaattagatgataaaaggaaaatgcaatgtgtttttaggttttatggtgaaatttatgtaaaacagaaagactgctggccctccacatgcctctgtctttaatcacaagcgacacttgggagcacagcggaggagttgcagtgagaaggcattgtttcctttctttttgcaaaagcaggagctcatcattcacttcctactctgtgcttcttcaggagttttcactggaagaggcaggcagacaggaggctccttagccagccatctgggaaagtgtctggtccagcactggtctcagttgagcacctgaggttgcacattctgactaagccaataatgttgtgttgaactcattgtacttgtttgcttgggctgctgtagcaaggtaccatgaactgaacgtgtgtgtgaacgtgccactctccctgccttgcaacatcagttataaactgaccttagggatcacaccatcacctctgctgtgtgctattggtcatgcagaccagccctggacagtgtgggaaggggttactcaaaggcatgagtaccaggtggtggtgatcctggggaagtgttggaggctgccttccagaggttgacatgttcctacagccccagcgtctctgggattagcatgatttctctaatactgcttttggaaaaatctagaaactgtgaaataatccagtagtatcatttttttgtgttatttccccttttaatttttttccttggtaagtacaaaattgtatttttttaatttattttttcagtgaacatttttttcttagcttttcatgtggagcatttcgaacttgaaaaaggataaagaggccggtgccgtggctcgctaggctaatcctccgccttgcggcgccggcacaccgggttctagtccctgtcggggcgccggattctgtcccggttgcccctcttccaggccagctctctgctgtggccagggagtgcagtggaggatggcccaagtgcttgggccctgcacccgcatgggagaccaggataagtacctggctcctgccatcggatcagcgtggtgcgccggctgtagtgcgccggccgcagtggccattagagggtgaaccaacggcaaaggaagacctttctctctgtgtgtctttttctctcactgtccactctgcctgttaaaaaaaaaaaaaaaaaaaaaaaaaagataaagcacagtataatgaacttccttgtacctgtcacccaatttcaagttatctcatagccaatcctatctcatctatacaccattcctctttactccttttttttttttcaaagtaaactttaggtatagtattgtttcattgtatatattcagttgagtttcttagaaaaaatagctttacaaacatcacaacaatgctaaaaaaatatttaaccacaatcttacaccaacatccaatgttgtcttcactttaaaaaatactttttatagtttatttgcatcaggattccaaatcccttacattacagattccagggtgtttgtgttttactactaaagtcgtagcattttgtattagaagattggccttggtcatttcacccattctatctttttagaaataagaacatttgccaagagccatgtggctggtttgtttaagattagaatctagaccttctgattctcaaattcagatgctttttattttaaggagtaggtattttgaagtgatggctttggaaaaaaagtttcctactctttggttcctctctgtatttaaagcagtgatgtaaacacagaccctcatcacttgcacttgtgtggtcagatgtgaagcctcccttgagctatgtgtagccataaccactgctttccctttttggtcagcctggaggcatgtctgtgaagtaaatggtacttttttttcacaaacaacctaaatctttcgtagtctaggattctacatttgctgaattcctcagacattctggaagtcttatctgtatattctcttctgagtatatagattcttttgtttatttttgcttctgtatcattccatagtgatcttcagtcttttttcatattgttggattattttaaaagcttttctaatattttgtgtgcttattcttatttttagaattttttttatctaaacatatgttgccagaaggtttatttaggaactgatagcatggtttttaaagattatttaatttgagaggcagagctacagagagagagattgattttccatccactggttcactttcaaatggctgcaatggctgttgtgggctgggctgaagccaggagccaggggtttcatcaaggtctcccatgtgggtggcagggccccaaatacttggcccatcttccactgctttcccaggtgcaagagcagggagctcagttggaactggagcagctggcatttcaactggcacccatatgagatactggtgttgcaatcagcagcttaactcactgcgccacggtgccagccccttagcaggttttgagtagcctgtctccaagcagcagctcttagctagcactggaatggagccttcactgcatgctgttggccttttttcagctcccaggcggaactagcagtttcagcatttgtggggctacgtctcttaccttttggtgggccagatcaggactaagcgtttacttaaatccagaaatattctgagaatccttgccatgttctgagagcgaatgattgtgggtgattttctctgttctccccaggcccggcagctcatcctgcagtatggcttaaccctcagtgacctggatcgacacccagaggtgagagcaggcagactgctgcgtctttctctgttttgatggtgctcgcttgtgcatggctctggttatcttgtcagtctagggaagaattaagtcagtggcaccaacttttctcctaaaattctgtgtgttaatcctgcctgaggttgtcacaaatgagctggttagtttcctgtatatcccctgtggtttaaccctaagagcgcagtatgagtgtagcaaaggggagctagcagggctgggctggcaaaactccgggcatcgtaggcccttttacagaggtgcaagagcaagctgactcatggagcttgccacctaagtggagataagaaataaccatctgaggcagccgcggaccagtgaaaacagatgaaaattaagttttgcggtcaggatggttgaacatggggcaggccagaagaggctgaagttgtcaggatgaacaatgtcacacatcaccccagccagcaccatccaagttaattactgcatgccaggtattatgctaagggctgtttgtgttgtgttaaattacttagtcctcaggattcttgaggttcggtgtcagatgatttcattttatatatgaaaaagtcagagagttagtcatttgcctaaggtcacacactgtttgtaagtggcagagccagaatttgaactagggcacttctggctctagagctgtgccagtcggaagagttttgcaagaagaggtagtttgtgctgagctgtaaaggctgggaggcaggggcaggagagaatatttcagagagggcaggaggaaccacgggaatatttccgcttgggcacatgggcctgtacagacagtgtacagcttgggtgctttggacagagtatgtggaatgtgtcgatgcatagtgtagggtgaggggctccatgccgtctagaaacccttggcctcgagggatcactaagagaaccaggggatttttgtgcacagagccagagcacaggcatcatcacctgtttagcagctgtgtggagagtggtttgggctgcgagtaggcccagagcccagacagaagaggtggctacttttcaggccccagagttgccacagcatagcttgaccctgaagttagtgtagggttgtggaagagtggtgcaggctgaagcttcagacagagactagaatgtgtgagtggagggaagtgagagcgccgcatgtcaaacctgtaggctttacacctgtgccatgccagccatgccaagcagctgcaccatgggtgcagtgtgtaccttgcacaacactgttttttaaaaagatttatttatttatttgaaagagttacacacagagaggagagacagagagctgttccatcctttggttcactccaaatggtgacaacagtggagcggggttgatccaaagccaggaaccaggaacttcttcaggatctcccatgtgggtgagggggcccaagtgtttgggtcccctaccactcacgtggagacccaaatggagttccaggctcgtgatttccatctggcccagccctggctgttacagccatttggggagtgcataagtggatagaaaaatctctctttctgtgtcccgccaccctctcttaactcttaccttacaaataaataaataaatacttcaaaaaaaaaaaaaaaaaactgcttgaagtctgtgttgtccttgcagagtaccatgagtgatgagaaatagatagcttcattggttttgtttatttgagagagagctatgcctcctgtcagctgtttcattccctaaatgtctacaacagctggagctgggtaggactgaaccaggcgccaggaactcagtctggggccccccacctgggtgccagtgatgctagtcacttgagccatcacttgctgcctcccagggtgggcattagcaggaagtaaggactgagaaagagcaagggctggaatccaggcatccaactggtgtcctctacttccctgatttggtttttgagagatgattgaacccatttgctcctcagctgcttttggggctggtggtagagcttcctcatggagggaatgggcaggcccagacagtgctttgggtcttagtgggaatgcctcaagtagtttctaacccaggaacaaattgaaatttcttgtatgtctgcccacttcagtgcaaagacttctctgtcagggtttttttgtttgttttctttttttaattgacatcactgccctgcaaggggggccccccacaacgggacatttaatagcactgatatattgtatatctgtttatgtacttgtggctttttggaaggccaaaaacaattgaatatttaaggtttttcacccccctacccccaagagacagtttttgcttccttgggaattttggtacccacattgagaatgcatgctctaggtaattctaacttgtccagagagaagtccttcagtgactagaacaagtatagcattgtgggtaatggctaatccaggtttgagtcctaagtcttctgcttgtttccttgtgaccctagtgaaggggtttaatcatggggcctcagctgcttttttaattaataaatttatttatttgaaagggagagcaacagagagagatggagaacttccatctgctggttcattccccagatggcaggtctaaaaagccaggagccagggattctatcccggtttcccacccttggggatccaagttcttgtgccatcttctgctgccttcccaggtggcctcagcttgttcggttaagtgagaatattggacctagctgctagggctgccgagggtctcatgggctgtgcatgggaaggttagcagagactcccctcatgaggcttaggggtttttgtgtctgtctctcccctcaacacagattgacctcgccatcgatggtgctgatgaagtagatgctgatctcaatctcatcaagggtggtgggtgagtgttggggactttcttactaaagagtacctgccagttaatcttcgccaaagcaaagtgcgatgcagtgggattgccactgtgatgtgtgggagtctgtctttctaccaggatgttgatggcaaatgtcctgagagctggactggcatgtctggcattagcagcagtgtggtgtccaggaacctgggcctgttcagggcgatgggtgattcatcttcatggccttctgtgtgtctgtgttctgctctctcaaaccttgaaaactgggcaggccaaagcacatattattgggctagctgtgggatcagtgtgtggcctttgctttaaaggttgtcttacctctgtgggcagctagggaagccattcatttatttggaaaataactgggttgttcttattttggatcagggagtggtgagttgaagaaggtgaagtcccggttctcacagtcaagtcggtatcgaatggtgtaaaatctacttcattgtccctaagattttcttctgtgtcccttggtcttcctgatggcagacgtgaggtgatttagctggtcagcggtaggggcaggcctgatcccaggtctgctgattctgtgtccagggcttgctccactccatcaccctgcaaattaagtggaatttctctttaagtgttaggttgggtggatttggggttcctgtatctgatcttagttccccagttgagattctgtcttgatcctgtactctttcttttttcccatcctcagaggctgtttgacgcaggagaagatcgtggcagggtatgccagtcacttcatcgtgatcgctgacttcaggtaagtgcccagtgttttgaactgcctgctgggaaatagagcgcacaaaaaggaacttgtggtgaaatagagactctgtgactttctgagactgattgctaggactaaggtctttttttttttttttttttaaagatttatttatttgaaaggcagagttacagagaggcagcggcagagagagagagaggtcttccatctgctggttcactccccagatggccgcaatggccggaactgcgccaacccaaagccaggagccagaaacttcttctgggtctcccacgtgggttcaggggcccacgcactcgggccatcttccactgctctcccaggccatagcagagagctggttcagaagtggagcagccgggactcgagctagtgccttatgggatgccggcactgcaggtggtggctttacccgctatgccaccctgccggcccctaggactaacgtcttatattctgctttcatattgaccgtagatgtcactaactgatcacagcattcttttttttttttttttttttttagtttatttatttgaaaggcagagttagagagaggcagagagagagagaggtcttccatctgctggttcactctccatatggccgcaatggccagagctgtgctgatttgaaaccaggagccaggagcttcttccgggtctcccacgtgggtgcagggtcccaaggacttgggccatcttccactgctttcccaggccacagcagagagctggatgggaagtggagcaggcggtagctttacctgctacaccacagtgccagccccatggtcacagcattcttaagctgagtggggatctcctgtgctggtccttatgtccatgagatagggaaggaaacagcttgtcaaccctactagcagagcaggtactcaggtgtcactcatcagattgtcacagggaacctctaagaagcaggccatgttctgcccatgggcagtgactcagtgtgccctgcctcctgcagaatgtgccacacatgacttgtgttgcagtcttcaaccaggctcccagagtctccttcaaggagtctggctaaggcacgtgtacctgtgtgtgtgtgtgtgtgtgtgtgtgtgtgtgtgaaagagagagaataagaattttacagcagctgtagaaaaagcataaacaaagtctgtacgtccacaaaccaactatataaaattccaacatttttgtgatatttgtttcaaatatttctttcccacagtggaacagccagtgcgtgtgaagccctgtgtctactggtcccatcactttctttcccttcccagcatcgaattaaccccgttcgtgaatgtggtctttgtctgaaccattgagcttattactttcatggtacttcttgactcttcgcaggaaagactcaaagaatcttggagatcagtggcataagggaatccccatcgaggtcatcccaatggcttacgtcccagtgagccgagcagtgacccggaagtttgggggcgaggttcagcttcgaatggctgtgcacaaggcggtaagtggccggggggggggggggtggtgtgtgtgtgtgcagagggcactccagtctgtcttaccctcctctctgctcctgtttggttctctgtgccttgaccaggcagccagttttttacttatttttaaccgtttgtttatttttagagagttggctttattcgtttctgtaatcaatcacatgacgataagactatacccaatatagtggacatctcatgtatagatgggggatgaatctttctttctgtctcttggaatattacattctttgggtgatctaacctttgtactggaagcccctccccactgcttaacagctgccgaccggagtttgggacagactttaggttccatgtgcaattttctttttaagtaaagaaaaaagattatttatttgataggcagagtgatggggagaagaggaaggcagagagagagagactgaggtcttcatctacttccattctcaaatggctgcagtggtgggctagtcagggccaaagccagaaacccgacactccatctggctctcccacatgggtagtgaggtctcaagcacttgggccatcatctgctgttttcccaggcacgttagcagggagctggatcagaagcagagcagccaggacttgaaccagcactctgatatgggttactggtgttggtgttggaagcaaaggcttacccagctgtaccacaacactgaccacatgcatcatcttttttttctccttgcttctctcatcctgtgtataaatatgacaagatgtagaattttagcaggggatctgactcctttatagtagtctactccagacactttagtccaaatgtttctctttggcttttcaatgggttggttgcaaaaagctttttttcttttacatgtaaacaagcaaaagaaataattcaacctaactatacttatagtctatatagcaatttatatgctaaataaaaagcttataagatataaagaagaaacaaaatgatctgtgactaaaccctggcacatttttcatttaatgtctttgctttccagtgtttttatgactttaacggaaaaaaaaaaacctagtcctaaccacagtgggttttcccaggctgtgactgatgttttgtggctcgctttagctgaagggccagagcaggttgtgggactgtttcttatagatggtttactccaggcaagagccttagctccctgccttcatggagttgtgtgtgtgtgtgttttcaatttttctaaaaacattatttatttgaaaggtagagagactgacagagagttctcccaactactggtttactccccaagagcccacaaaagctagggctgagccaggctgaagccaggagccggagactcaatgcaggtctcaaaaatacttgggaggcggagagccatcactttcgctgcctccctgggcatggattcacaggaagctggaatcaggcagaatccaggcactctgatatggcatgtgggtgtcccaagaggtgtcttagccacctctaatgcctgccccagagttcttactcagctcctaccgcttctcctctagactggaggggagccctagaatccctgcccttgaccatggtgtctgtcaacattggtgttcctaaacactccttctgcttttctagtattcagagctattggggagttctggactaacagaagtaaacctacccctgcctgtccgacttcagagcctattgctgctcatgttgggcagtgttggtaatctgttctgtggtgacttttcagtataatgacagctgacttattgagcccttactgtgagccctcattgtggtaaatgtattatctcctagggtcctgtggtgacagataatgggaattttatcctggactggaagtttgaccgtgcacacaaatggagtgaagtgaacattgctatcaagatgatcccaggtaacgtgagtagcgtttactgggcagagtcaccgtgccctttgtcactgtcccttcattggccacagaaggcatgatggacgtgggctttgaaggacctggttgggaagaagaacttggtttcttttcatggtgtccgggctttccagcatgggttcctttgtcttctccccaggaatgactgatgcataactagcagcttggtgcttgtctcttgcagccgtgggggttgggacagccctggagctgatggaaggtcagagggccaccatctctgggcagagtcttgcctgccaggagctgactgaacctgcgttggtttttctgggctgtcttcttaagtagtggggaaattgactcagtgtacctacagccattggatacgtgccacgggcaagatcctgagctccgtgctacagaggaggctccaagcagaagaacatggacggaatctgtgctcagtaaacctgggaaagctctgtgtggctgtgtggagtccttgcctacagacaagacggagtggcctaaattctgctcggggaattccaagagcgcacagagctgcttctttgggggaatgtgagaaactttggtgacgtggaggtttctggtgtagatgtaggcctgtgtcttagcacagcgtcacctagacagtgctgaatgtctaagaaagtttcactttattcccacgatgatgaggcagctctagaggaggacacaggctgagcaacgttatgcagtttaaccagcggctgcagcacccggatgggagccctttgttgtctgccctggtccctgagctttaatctctacttggtcaagtgccaggctaaggagaggttgtgtgacccgaacggtgagagcagtgggggccctctaacacagcttgtgcctgggagtggtggggtggagcaggggggctcagggtgaaggcggggtgggcagggtagagatgggttttgaagccttagcctcagtgcccagaggaggaactgagggcgctcgtacgggggattggaaggagacgaggcgtgggaggcatcagtccctaggagtctaactgggagttttccatgtcagggaatattcttgagccagaactgacttaggaggcagacaggccaacttagtagaaaaggccaacttagtggctcagagcagctgcctgggttcggatcctcatcctgccacgctctagcactgtgaactgagcagttagtggacattttctgtgcctgagatcctccttggtaaaaggggctgatacagggttgtcgggaggattgatgtgttgattgaatgaaccctgggaagaaaggacaccatgtcttcggcattagttgggtgtgtggattctcagtcatccatgctagctgggaatggagatggtgtgactgtgtgccatgtaataaagagccgattcttccaactctgctttagttatcttgtcttctgctgacagtctgctacaaggtttttgagtcagaaagatgagttgaactctactcattctcttgcttaatgctgccttcaatggaagaattaatgaaccgagaaggcaggagggagagaagacacagacactgctgttagtaaactaggggaatttgcctacgatgataatgcagacaaatgcgggggtccaggtgggaaacggctcatccgtgtcggtgctgtttttctctaagataggtttcttgcagtgtccactagggggctctgttgcaccgcttcagacttttcttggcttatggagccactgaggtgtcccttgtgggggagttttcctcctgtttgttttctacctaagacgtagaagctacatgtaggaacctggagtgaggaaaatgtaaaaagaggttagctgttaagtaagataatatggtatcagcagggccaaagctgttttgggttcttcccgccatgttcaccttagcatcctccaaccttccactgaggtgggagaggcatcagtctttaccagcagttctttttttaattaattaatttatttgaaagagttacacagagaggagggagagagagagcacaatctgttggttcactccccagatggctgcaatggctggggttgggccaggctggcgccaggagccaggaactttttccaggttccccatgtgagtgcaggggcccaggcatttgggccatcctctgctgctttcccaggcatattagcagggagctggattgaaagtagagcaggggccagtgctgtggcgtagtgggtaaagccaccgcctgcagtgccaacatcccatatgggtgccggctgagtcccaactactccacttacaatccagctctctgctacggcctgggaaagcagtagaagatggcccaagtccttgggcccctgcacccacatgggagacccagaagaagctaatggctcctggtttcagaccggccattgtggccatctgggaagtgaaccggcggagggaagatctctccctccctctctctctgcctctgcctatctgcagctctgccttttaaattaaaaaaaagacaaacaaacaaacaaaaaaactttaaaaaaaaagaaaagaaaaagaggagcagatgggaattgaacctgtactcatatgggatgttggcactgcatccggtggcttaacctgctacaacacagtaccggtcccatctctggtttgtttgtttgtttgtttgttttttaaaaagatttatgcttttatttgaaaggtagagttacagagagagagagagaaagagaaatcttccatctgctggttcactccccaaatggctgcaatggccagagctgggcagatctgaagctaggagccaagaatgtcttccaggtctcccacatgggtgcaggggctcaagcacttgggccatcttctgctgctttcccaggcacagtagtagggagctggctcagacatggagtagccaggactggaactggcactgcaggtggcagcttaacccactactactgcgccggcccctctgcactttctttacggccttttctccacatgatctgactttcctggatcagaacggtttgagaagggtggatgtccagtggctgctttgcttatacttgggaggccctggttgtggaggccagtttggtgccagggactctgtgttttggtggctcactgctcctttttatttgtttatggttggctagtttttaaatagttttgaaattatgtagttcaaatgagtaaatagtggcaagtttccttccccatttcccaactaactagttaaccatatctggaggcagccaatgttagaaaaaagtcgtgtggcctttcaaaaaatcttatttatttaattatgtgtatatgtacttatggattttcattttatttgaaaggcaaagaaacaggggtggggtcggagaagagagacagaggtcttccttctgctggttcactccccaaattactcacaagagctgggctgggccaggcagaagccaggacctgggaagttagtctgggtcttccaaatgggtgacagagtgaagtcctttagccatcaccagggtgtgcatgaaggaagcgggggttagaagtggagctacagcccgggcactccactaagggatgttggggttccaggtgctgcttcacctgcagttccatggcacccaccactgcctttccacagtgaccgcatactttaatatgtgttctgtccctgccttttctgtcttggggatcattacatgctggctcacagaagagcttcctcgttctttcctcttttaaaaataactctgctattcattttatggctgtataacagaacacttaactggatcccatccagtggacatttatgtttccagtgctttgctggaagggaattactggatcagaggacaagcaagcatgtctgattttgctagatggtgctggcctgccttctgtgggctgtactcattggttctaccaccagcatatgcaggtacctgattcccaacagatcaagtttaccaaatgttttttctcttaatgttatctcatgagtatgtgtgtgaacatacaaatattggtaaagatcatgcgtggttgtacagctgtcccttgacatcccttgaggcttggttccaggattctctgtggataccacaatccgagggtgtgctagttccttacataaaatggggtacataacctgtgcatatcctcccgtgtaccttaagtcatctctggcttacttagactacctaatgcaatataaatgttgtgtaaatcacaaatcgctgttacactctagtgtttaggaagtaatgacaaaaaggtctgtccctgttcaatatggatagaattttattttttcaaatatctttgagctgtgcttagtcgactcagtgaatatgaaatccagatgcagagagctgactgcggttaattctcattgctgaatagtgtcccatcgtctgtgcgtgtgagaaatatgtttgtgttcctgatgggcatttgactattctgttttcagttattggaaaagtatggctgtgaacatcttatagatgtattttcatggccatatgtatgtctgacagttgtatatctagaagtaaaattgctgagtggttaagcataatttgttcaactttacaagatggactaatcaaacattctccacagtgttcttgccagtttaccgtccatcatcagcgtgtgagaacatttttgcatcctagccacgtttcatcattaaactcatttttgtgtagtgatagtttgtagacacaatttgtgactaatgaatttgagcatctgttcagtgtttattagctatttggttagggtgtgtgtgtatgtgtgtgtgtgtgtgtattgagagagaaatgtcttacatcagctggcacagtccccaaatgcctgcaaatggcttgacaggaccaggctgaagccaggggccaggagctccatccgggtttccacgtgggtgatggaaatccaagtgcttgggccatctgctgctgccttccagggtgcattagcaaggaactggattggaagtggaacagctgatactcaaaccagtgctccggtgtgggatgccagcaattgcaagcgtagtttagcccactgtgccaccatcccagccccttttgtgaaacacctgttcagatcttttgcccatttttccgttaggttgtgtgctattttaatactttgtggagttgtttatatattttgatgtgggtcctttgttagatatcggcttgaaaatgtctctttccactctgaagaaatcctgcaaggccagtagtgaagctaaaaatagctaggagtgggggctgctgggactagtcctggagagtctgtccagaagtcagcctgtcatctgtggtgttggagacgtggagaagtccttcctagaagcgcttgactggttcaggcaaagggaatgcgtcagcagaggcctcgaggagtgacaaagcttggccttgggtacggaaggaaagccaaaagaaggggggagaaagaggcgacaagaagcttcacagacaatcagaatcttttcattgctgtgtgggagaggaagctttggctgtcatttgtccagtgctgcctgtgccggttgcttctggtcaccccaggacccgatcctcttgccttgggaagctggcactcactgcttctttccatgctttgtccttcaggtgtggtggacacaggcctgttcatcaacatggcggagagagtctacttcgggatgcaggatggctccgtgaccgtgcgggagaagcccttctgctgaccccacgaggagcagatgtgttcaccttggtctccagcccacagccagggtggccgtgcctgtccaggagcctttgccttaatgtatggggggtgggggtggggtctaagcccagtcgtctgcagtattgttactatgtgtctttttaaacagagaaatttaaagatatatatatatatatttttactatgaaaaatattcagttttttataaagtagaacttgatttcatgttttatatgaaacatttaccaaaaaataaataaataaaaaagaatagggcaagaagggggagactgtctttaaaacctttgacttgagcctgctgggtttgctgagaaatgaatatcagagctttttttgaagccggtcacatgaaggacctggacagcagtgatctcctgatgccttacagcatgcttggtttacttttctgccactctctgtgtgtttttagttcgttctcattgtaatcacgcacaatgcagttacttctgaagatgaggtttacaaagtccgctgagtggaacagtgtgacgtttggtgacttgggattggaatgtaaactcccggggcaaatgcggtggcaccttcgctaagatcagggctttgttcagacccctgttgttggaagcagttggccggaaatacttgccagtgctgccagggcactgctgtgaaatgtgaaatagttgttttttttaaaatcattttctttttgttgttacttatttttctgttgctttattattactggcatggtttggcatcagatgtcatcacctctttatgttctttgaaggttggaataaacagtgtggtgccattttgactcttggtcttctctacagaatcggttgggaaatggggatcagtatggctgatatttgataacgggtggaattcactggagaaatcttgagccgaagaatacttcctttatttctgggagagcttgcttcagttgcctaaggaaatgcttgttccatagacttctaacagttgaacaaagtcaaaattctcagttttatatgaatcaaagcttcgttagttgtgaaagctgataagccacagaataggtaacctgaagttcctttgtagtgcccccaccctgtgagctcagacatctgcctgacaagcagtgagctgcccagaaaacagtgtcacgggcgcagcttggcgatagctctagggcctccctcagaggaaccgttctgttgccaaaggctttctgctgagagcctggctcctctgtgctaactttgcacgatgcttgcacagtcattccccctgttttccgcctgttttgaagcttgaactattactaaattcctgctgaatcacgttgcagaataaaagttaatcaggactgactgagcatcagagacttcttgttccttgccacattccttggtttttgcactcccaatgtgctcttcaaaatgtctcatcctgtgttaggaaacctgctgttaggagtgcattgtttttctttcagactgcctttggtagggcaataatttttgcacaaaacaggtattagctcttagttgaacacttggtagagcaagttttttacataatcctttaaaacttttgtggcatggatttaattcagggatgaagatgaagttaaactgggtttgtgaaaaacacctgcatgcttcatatcacatgtaaattttctgctggtttgtaacattcacacctgtgactcaacaacaaggtctgaatcttaatatgaggtttttcttcccttgaaaacaaacacctgtgatactctaggcacaagcaaaacagtttgctccagagacaaagtttgcttcaataaaatagttattcaatgtgattctgctggaaataggacagaaaaaacaatttgcttgtacctgagatcagttttgagagactcaggacaagcagtaagtttggggaagctgccgcacttctgggaggcacctaggagaaaaatcacttggattcaaataaaattaatcatttttggcttcggctagtacttcttgtaaagttctgacacttaccaagtttctgagctcccatcatggaccaatccctggtgggcactagggaaatggaagggtgggacacacatgagccagatactgcctgtttcccagctgcttgcagcctggtgggcaggtggacaggtgcgccacgatggatgagtgtgggatgcttgaggggttgtcagcaccaagggcgggagggtgccatcagcaaggaaagtggttactgtgaccctggtggcagtgtaggccatcactactgcctactgctaccaaagcacttctaaccgaagttaaacaatggccagtttgtggtggaggcacagggctgaagagttagttgcagacgtagccagttagtgagcaaatgagctagcctcggacccctggtttccaggtcgggggttttatagactctgggaggattctcatgttaactataagaggtgccacggatgtcacattgtgacttcttgtgggaaaattccaatggattcaggcaagtttcaaagaaaagctaattttagagggatcctttcaagaggctgacttatttccagagaagagctttgctttaatgtaatgtttttaatgtgctgtttcagtagcgtccaccttttgtctgaaggtggtgaggaggggtaacgaagatcatatctgagtgctgtgtaccaggtactgttctgggcctttgcccgttgtcccacgcagctttacctagcgtcctctcggtttgcagggttcagagaaccaggctcggtttaaagtaactcatcacacactgggaagcaggctagccttctctgactccaggcctcctacctgcttcaagatcaacgtcacacttagaatagtttgtgttgcctaatgtgtccatcacttgtaacttgagtcacaagtcatttgttaaagaactgaggctgagctgttctctggaacacagggaggcagcctgtcgggtgtcccccgcctgacaaaaaacctcccttaaaaaaaaaaaaaacaaagaattgaggcttgtgaatggtgtgcatctgtttgtacaggcccatggctaatataattctatattctgaaggccgttctttaatgggagaagaaatagaacagtgcgcacgaccttgggtgggccatgggagagcatctgtcactctggagtgaagcctgacaaacatcgctgtttctcctgtcccatgtggttgtctgcttttcctccttttctccctgcgacagaggcacaatgacaaccataggcctcattaacctggaaagggatggttatgggtaaggagtgttggttcctttgtatccagaaagcgttcaggagcacacacatgcttgaacagagttgggtttattggcccattgagtgagagaattcacctgctgtgcgtagtggctggtgtctcaagggtgtcaccttccttgggctcaaggaactggatgttgtcggaaagctagattgttctgtgactgagtgtcttaatttttttttaagatttattttttatttaattgaaaggcagagttatagagagaggaggaggagagagagagagaacgagcaagcacgcttccatccactggttcactccccaaatgcctacaatggatctgtctggaccaggctgaagctaggagcctagtgcttccaggtctcccatgtgagtgcaggggcccaagcacttgggccgtcttccactgctttcccaggcttattaacagggagctggatcagaagtggagcagctgggtctccaaccagcacccatatgggatgccaatgacacaggcaggggcttaacccactacgccacaacaccagccctgtcttgataattcttagctagaaggtaagaagatggaagaaggctggagctggcaatgataaagcagcagcaggtgctccctagccaggatggatgtttggtcacttctgtgacttggacagtgttcaggttttgtccgtgttgagatgattcggttgtagccttgttttcgtcttcatccaccgtggactcagatggctttgtctgatgtcgatgttctgtgaaatggtgtgggtgggtgctgggcctgactggtagagccaggccagtccctggctgtcgggcaggatctctctttctcgggatccagaggtcctgggcatcccataatcagcccttcaagctccccttgttttaattgtatgtagcactcactgtgctgggcagtggggtggaggagttgggctgcagataccctgtggtgtggctccagccctgaactcattggcaccatgacagtcacttcttgtgacttctcagatgcctgactgctcacttcctgtcacacctagcagctgatgcagacagatttaggattgcatcagccttcactctccactaacccagcaatcagatggtgtttttgacagaggttcagtgcctttgtgtttttagtaactgggttgtgttgcagggcagcaaaacactccaatatagtctagcattcaaatgtgccccaggcagcctcagaaggtaaacatctagtgggtctttgtgggggggggggtgtgatagttcctgagggcagtgaggtagaggcagagttcagagggaagaaaaggtcttccctggcaaggcaactccagcgttgtgtgcaggcgcatggtgcaggccgatggacagaataaatccggtgttgaaacctgattctgctatcaccgacgaccacctctgctcagcagcaaggtgggagaggaggagctctgtcccagagaactgaagtctcagccccgtggaataagacccctgcccgtcccacggatgacagcactccattttgatggtgttccagagtttcagatcagagagttgtgctcaccttcatcttacttcattagctgtcctcagcggaaggcaaggcccggctgcagtcactgatggcttcagaagcctcagcccctgttcctctgtgccaagggtgcttctcctgtcctttgtgaacctttgaaaagcactcacaaagcgagagcccgcagctgttggcaccagctcaaatacggtcaagaacagcactccttagaggagtgtgagccttatgtgtgattttacatgttctagtcaccacactcagaaggtaaaaagaaacaagtaaacttaactccagatagctaaaatactgctattttaacacacaatcagtattttacattttttggcattttcttgagaatgctgtgtgtatttcacttgagatgtctcgttggaccagccccattcaagggctcaacagcaacctggtgagtgactgcagtactggaggtcacagaaccagaattcaaggccaatcctggcatggcccttgttctggcttatttaaagctcctctgatttcttggagtaagcctgggggttctcctgtggtcttaaggtgtcttcacaggtgggcgccgcccacagcatcccacaactacagaggtggctgcggcttgctcgctccccggaagctgccccttccctggggtcatgatgggcagtaagatggcatctgccagccgggtcgttcaggtagtcaaaccacataccccattaataaggttccctgccagaagagacaatcctaaacccaatgtgtctgaagtttgagatcagctggactgccgtgtcactcttctgcagttgcacagcaggctaaggaagtagaccaccggatttgctgatggatcaggggccaccggacactgccgaaatcattaaatcattgcctcagaagtacagaaggaaacctgtacctcaagaagaaatggaatttgtccaacgtggagatcccgagtaaccgctgctcatcaccagacagaagaattgtctttataataaaggactccccaaatgacaagtgaaaaattgtatattaaatagctttaataaatattttgtaaaaataatgaaatatagaaagtttagataaacacccatatctcctaatttgtggatcttggtcagcttctctatgaacttacctaattgtttatgtactttatacatactaaagtatacataaaaaaaaaaaaaaaaaggtgtttcccaggatcacagaaagttgagtcagatggagagctaccccagagggtcaactcagtggccccacttgaactgagaccttcatctctgcttccagcagatgaccttgaccttaactccaggaaagagtaccatcccttcagcttctaaactaaatgagtgttttagttgacagtaggctagtttttctaagaggtaagcatgatgatgttaataactgttagaaatcccattcttgtgtgtgtgtgtatgatattttccgtaataaaattgctgaaatggcttgtcaatttttggaatttaccaaaacaaaaccttccatatagtatgtcatttaactttacttgggtgtgagtatgtgtgtgtgtgtgtatgtgtgtgtgtgtgtgtcttctacttggagatgtcagggaaaaatcccagaagtaggtggttttcagttgcatctttttaaaaactgtgcagtgtttttacaagctttattgagatataattcaccatacctaattcacacatttaaaatatacagttcagtggcttttaatatatgcacagaattgttcaaccgccaccacaatcagttctagaacatgttcatcaccccagaaacaaagtcactccatatttccacctaatcaccctgacccccaagctctaggcaaccatgaattcactttctatgtagcattgactcttctggacatttcatataggtggagttgtataatatcttacatctttctatttttaaatttattgttattatttggaaggcagagagacagagacagacagatcttccatcccctggttcacttgccaaatgtccactacagctggggctgggccaggccgcagccgggagctagaagttcaattcagatctcccatgtgggtgacagggacccaactatatgagctatcacctattgcctcccggctgggatcagaagcagaggtgggatttgaacctaggcactctgacctgggatgcaggcgtccccaggggcatcgtaactgctgtgccaaatgtctggctgttcttaatcagcataatgttttcaaagttcatccatgtggtagcatgattcagcgctttattctttttattgctgaatatttatgatctagatgtgccactttattaatccatcagttgatgtttatttgggtgttttccactttttgactactatgagtaatgctgctacaaattcttgtacatgcaaattcatgtacaagtttttgtgtggacttatgttttcatggtctggtattttgttgttcctctgctccttccttcctttcttttcacttaaataaataaataagtaaataaatatatgtgtgtatgtataacatatatatatatacatatatatatgatttattcagactgatgtacttcgttgtcgagttttagatcccaggaacagggaaagctaggaagcactgtaattacaggcacacatcagttgaacatatgagattgaggatcacttttttcatgattttatttatttgaaaggcaaagttacagagagagaggaagagattgacctttcatccactgggtcactccccaaacagctgcagctgtcagggctgggtcagctcaaagccaggagccaggagcctcatctgggactggggccattcctgctgctttcccaggcacattagcaggaagctggattggaagtggagcagctgggacttgaactggggcccttatggaatgctggcattgtaggcagcagcttaatctctaccacacactggctctgaggaccactttcataggagcaaaagaaatcatctcactgggttaacttttactgttcacccaccatagggtgtgcataagcagaaaagttgggtcagaagaggaggtagggggctggcgccgtggctcacttggttaatcctctgcctgtggtgttggcatcccatatgggcaccgggttctagtcccagttgctcctcttccagtccagctctctgctgtggcccgggagggcagtggagggtggcccaagtgcttggggtcccgcacccgcataggagaccaggaggaggcacctgactcctggcttaggattggcacagcgctggctgtggcggccacttggggagtgaaccaacggaaggaagtcctttctctctgtctctctctctcactgtctataactctcaaataaattaaaaaaaaaaaaaaaaggagatggtgggattcaaatccaggcactctgatataggatgtgagcatcttaagcaccatgccaaatgcctgccagccaaaatataatccttagggtgggtgtttgacccattggatgaggcactagttagtatatccgtgttccacattggagtgcctggattcaattccaagctttggctcttgattgcagcttcctgctaatgcaaatcctgggaagcagcatgatggttcaagtaactgggttcatgccactcatgtggaggacctgggttgtgttcctgggtcctggcttcagcaatggccctgtcctgaccattgtgggcatctggcgaatgaaccagtggataggaactccatctgtccctgcctctctccatcagtatatacatatatgtacacacacacacacacacacacacatgtttcttggaaagaagacagctatcgatgattgtagaatcaaatcaatatataaaaaggcagatatgcacatccagataagaatgttctgagtgtaacttttttttttttttttggtctttctgaacttcttctatttgaaatattcctcactgtgggagcttactgcattatatggcttcctgtctctaaaatgtccatacccctgttccccaattcactgttcctgcccagggtttgaaacttaagggggtatttcagttcattaacgctgcatggcaaattgctcaaaagcttagtgccttgagacagccctgccatgtgtttcctggagcaggccctgatggggaaggctcgtttccgttgcacgtgttttcagcaggagcagtcaggccagaatgtttgggggctgcttgggcctctccctgtccacgggccgtcttgggctttctcacagcatggcagccagctggattataaggagtgttgtggaagccgcaagtcttcctccgaagtagaaccatgtcacccccacttctattgctccaccaaattgaagtgccactggagcttccagaaggtggagacatagacagcacttcctgatgcaggaatgcgtgaacgtggggtttgcacatcgtcacagggagtgacaaagatgcaagaagagtaacgttggctggaggcatccagaattcagtggtagttggctgcagcatcgagtggctttatttacactgtcgtagaaggggaccttggccagggtcccctggttcctcctactttatgaacctaatttttcagccttccacccactttggaatttcatgatgtcatctgagtaagtcccacctgcttcatttagccaaagcgacttctgttgtttgcatctagggcccctgaccgatatcctggtcaataagggaatcactgaggactgatgggaaaatagaggagaaaattgaccagaggaagtgcagatggtcccactcactaacaagacaaacaaacacatctgcatgaaacagtaacagccagatgccttttttgcccaggaagtgaccagattatttaatgtaatcaagagctgcagtgggcacgatgagaccagctttcttagatggcaggtgggattgtaaactggtccaacgtttccttcctggagatttttgggcaacacgtatgccaagaatctttaaataggtcattcttttttagtcacttccaggaattcagcctctgcaaattcttagtgatatggatagaaatttatgcacaaagatgttcatactcatgttatttttagcaaaaattggatacttgaattatgcgagtcaatgaagatgtgatgtaataaggtgtgcactcattgggcaaggcttgtaaagaactaaggtatagaaaagcttcaaaggaataatactggtgacacatattaattaagcaatgtgatgtatactaggcatgacccaatcaggggaaatacccccccaccccaggcatttctaaaaaagggcaatgcttcaccggtgaagaatggggaaccagtcattagatgagccaccacaggaagccatgccaccctcggggctggagacggtggtggtacccgaacccccaaactggatactcagtgagatctggaatcacggagcagatgtagtcactgttggaaactccttcctcaaagcagaaagagagaaagaccctggattatcccttcctctactctctggtctcttgccagggcctcccactggccgcatctagctggaagtcagttgtgaatggagccagcgacaagaagtaaatctgacagtagatggacaatggctgccacacagcatgatctcaactagataaaaattatgcttagtaaaggatattataagtagttatttttgtggatggttttatatgagtatatagcttttcatgtttttctgtatgttctagagaacatgaagaataaaatacaaaatgagaaatgtgtgtgtgtgtgtaggagatgccaaaagtatttttcaagaagagaataaaataaaaccacctttggaggccagtattgtggctcagtgtcttaagctgctgcttgcaatgccagcatctcatatcagtttcgggttctggctgctctgcttcccatacagctccccgataatgcacctggagcccctgccatccgtgtgggagacccggatgaaatttctggcccctgactcctggttctggcttggcctaaccagacctggctgttgtagcaatttggggagtgaaccaggggatggaatatctctctctccatctattcttttccatcgctctgactttcaaataaataaatgcttttttttaaaaaaatatgattatatatgtgagcatggatgtaatgctgtccacgatggagtggagacttactccctaagcttttatcagtgcccttcaaagtttgggtgttctcccttcctgtggccaacagggggcgctcctgcccagcacatcaaggcctcccctgacaggttgctgaggcagccattgtagagcaggatccctgtcctctccatcccagaactgaccgtttttttggttttgggcaagcttttgccaggatttatgggaaggccatactgagtagtcccagacctcgaggggccttcattgatccttcagggtgctgggcacctgtgtccattcttgtgtttgtactgattccagtgacctaaaggaacttgtccagaggtaccagcggccactgcttagagctgtcagccccaggtaacagttcacagtcatgcacttgtaaaatcactgtggtttttttcccagtaagtcattcaagtcgctgtgtccagggctccttgtttttgcgtttctgctattttttggagccatcttaccctaagtgactgactctgggagaccagcaaagtgccaggtgtgactagagctgcatggtggccaagtggctggggacgtttcctgcagggaagctgtgtgtccgactgagagccctgctctcctcaccccatctttgctctcccgggcacacatcgctgcgtgggggccaggcctgctgcaatcctgccttcaggcagatggttttcactgaacatctccctaagagtccccaggggtcagcagaaattgttgtagggaatggcaaggctgtcctatgggagaaacaggtcaaactgcaaataggggacattgcagaaacacagcagggctcagatctgggaggcagctgcagccccacaggcagcccctgggctgcactagggctcccacagtgagcgctgccaacctgctgcccgtgcagaaactctgggtaaggtctgggtcctgcgtgcctcgggccgtgtgcccctcatggtgtgtgtgtgtgtgtgtgtgtgtgtgtgcgtgtgtgtggtggggtgctgttgaaaatccaagggaggtggaagaatgggttcatgtaatgttttacagtttggcttttccaagtagccctcgtcccatcctccccactgggagcgtgggggtctcctgtccctcagcaagtgtggaatgctgtgctagttcatgcctttctgttttggaacataggttgcgaccaactgaaggaaaagatcactttggtgaaacagaaagaaattgtgaaggcaaaatatattcttcagggtaaagagggctctgggagcagttttaactgtgaaatcaaggcatggttcatcaacatcaggaattgcaggcatggaaaactgagtgccagaggaagcattatcctgggctcggagattcgcaaagtgcagagctgagagctgtgctctgagctgataccccaaggcaccagatctttcctgagtgcagttttcttgggttttatttcacgcactcttatttttattcagatgtaattacatgtaatcaaactctcataatgctgtcctatctttagaatgctatatttgttataaaatgtatgaacaaaattttgtatttatgtttaaaggagaaaaattttatatttatgtttgaggaggaaaaaagtaatcctttgggattgtgttttaattgcatgcatgtgataagtgctcattaattataaatttatttcatggacaaaatatatttcctgggtactctgtccttgagggagcccacaagaccatctgtaattctgggtttgcatttgagtataaataatggcagtgagtaaatgatccaaaatattcatccaaaggaaagactgcattctcaagccattaatggaaataatcagtattttttataattgaattttatagtaagaataagtctaaacatattacaaaagttttggtttcaggagtagttgatgaacaaggagagctgatgtgagctgtcttcagaaagctcacggaaaatgtgtactatgaaaaaaccgtatatatatttcaaaaaaatttccccggtataaacttacctttaattccattttccaccagctttctcagagtacctttgtgtaacctgtgcctgtgagccttcgcttgctcctaacaccacgctttggttttagtccaccttaaagaaaacaccaaccgactttagagcctaaagactttattaaaaatgtctcggcatgggctatatggagcagtagagagaattacttcccagccacttttcccccccagtatttgagtattttaccagatgcattggttacctttcaaaaaattaaatgggaaaaatttcagtagtgaagtcagtaaaataggtgacgattacagttttttctttaacatattttggccttcttgaaaactcttactaatggaactagacaaatggatgtgaggagtcagagaagagtgacctgatacaccagagcatgcgtctacccccagacatgcctgttactttgttttagacgattctctcaatctgaaatattttcagttctcagtccagaatggttaagcttatccttagggctcacatggcacttgccaatggaagataattcatgattctggtgaaattttacctctcagatcacttatgttgggaaacactgatgctagtctggttaaggaatggccctggtgtgctggagtggggtcaccatggccatggagtgacccaccgaggaccaggcaaggccgattgcttccatctcaatctgaacacaagcaaaggtttatttcttgattctgctctgtggtactggcaaattgtccctcctcttttcctgttcttgaatactacgtattgtaggaatgacactccaacaacacaaattttgaaggaagtaatttcataaccttgcacttgactgtaacagcggtccgttccttttccagtcatctttcgtagcacatacagttttacacagagctgagtgtggggcacttagaactccacacttcacaaaagccttattgatttatggttttccaggttgccgagcagattttagaagcctcttttcaatggactgcgagtcagcccacggagttgacatcctcttatttccttggccatttcttgtaacttgggcatttaggatttttctagtgtttgctgtttagacttcttgaaattactgagttaagagaatggggttttaataacttttgatatgtgttactagattccttttcaagaggtgatattgagtgacaaatgccaattcagtggccacaaatgttattttccaccatttaagctttgtcttgcagtttattttcacacatctgtattttcctctctattcagcagaaaaaagtgcttgagggtgaagtagaacgtggacatgtgcacacgtgtgtgtgttcatgtttattgtgaatgcctaagtttcagaccctgaatttgatgaataatctcttaccgagaaacagaaatcaccaacttagctccaggcctccagtctggttttagttcttatttggcgatccagttctgtatgtttttggcacaaaccctgaacagtgaagtggaagcttcgactttctgtttcgatgaccgcaggtgtctatccagagagagagagctgagggacattgttcctgcaggtgcagtcacacggggccacgtcgctgttttacagttgggagagtgggagggaacgtggaggccccgggccgggaggctcatggggctgccttcccaagcaagcaaatggcttctgcccccattcctgggagccgtcgttcagaagccgcgtgcactaagcctgcacagcattttcctgaacactgaccatcgctgaacctcgtgtgagagtgtaggcaggtgattctgtccccagtttcacagtagctgggggaactctggcatcagcatccgataggggcagaatgaaacccagatgaatggtttcaaatccagtgttgccttttgattcccatttctgcctctgactactcagagcctgctgtctgagagtggtcattctcaatggccagcgacagcacagacgatggaaaatggggtcacttgctgtggcaagtttgtccagtgttgacatctaagccaggacacttaggggtttctagatttaatttgtgttccttctgactacattgtctgaacaacccaggtcaccccctgatctccttcttgagccgtgtgggtgcattcccagcacctgtggggatgagcgtgtgttttagggggttggttcctgcgggtgtatggaggcctggggcctggcgcaaggccgcgcctggggagtgagaggaccagctgcacggtggcccacctgtgtctgccgctttggcttctcttcgctggcttactccctgagcgcagttcttctctaaatgctgcttgaaaggaagacttcaaggcctcttcagattacatgattatttccgcattatacatagcgaatcatgcaccaagaaaggaccttaaatatttttttcctattgccctgtggcggtcatgaccttttagatgagaaggggacctccctaacctctcggtccaacccctgatgtcacacatggggaagctgagtgtccctaaggtggtggcagaggggggactccactccactgcctttgtgactgcccgttgagcgtctgctatgtgctcttatacgaaggggaccagagcggcagagggaaaagtccctggtttagaaatcggaggcaactgagagtcctggctgcagcagcaccttgtagctgtggagcccgctgcagtttataaacgttgaaacacaaagaagcatgggtatggcagacagggctcacttgctattttatgaactagagtccaattcaccagcattttacccctggttagcactgcaatgtgtgagacactgaatcatcagaagaagtaaatcattagagaaaggaaaccaggtctcctggttttattttccttcagtaatgatttggaatctgtttggtttaactggagtaactcattccttaaggaaagtagctaacatggaattttctgaggttccttaattacttctgtcagtttctttagcactgcattgagtattttgtttcatctgttgctaaagaaatagagtttttggattctttaaagcttttaaaaaattaattgtatttgagacacacacacacacacacacacatacacccagacagggcagggtgaaggggagaacgctcacatctgatagttcattcccaaatgtgtgcaaaggccgggggccagtgctgggggctgggaacataatccatgtctcccacatgggtggcaggaatacagtcatttgagccatcactgctgcctcccagagtcaggaggcagagccagggatcaaaaacccgggtaccctaatgtgggctgtgggcacctgaactaatgtcttaaccgctaagctggacacccaccctaggcttgtggattttgattactgcatataacatatataaatcattgttttgataaagcacagaggtctaatgacatgatttaaaacaaaaatttgcgaaatccttcaagtttgagtgacaggttcttggacagaggatgctaccgagtggcctgtgtatcacggtggaagctcaaggacaggatttgatgctcatgttctgaaaagaggagacagagtgaagcaccttgtcttgaaaaccataaacaatgttcacctggaggctgataaaattagcatgtaaaaataacaagaattatctttacctagaccctgtgttaggtgctgtcatgttgccactattttttttttttttttttttgacagagtggacagtgagagagagagacagagagaaaggtcttcctttgctgttggttcaccctccaatggccgccgcggctggcgcactgcggccggcacaccgcgctgatccaatggcaggagccaggtgcttctcctggtctcccatggggtgcagggccctggccacagcagagagctggcctggaagaggagcaaccgggacagaatccggtgccccgaccgggactagaacctggtgtgccggcgccgcaaggtggaggattagcctagtgagctgcggtgccggcccatgttgccactattacaatagccattgatgaggtactctgttattatccttaaaaattacagatgggtccagtgctgtggtgtagcgggtagagcctctgcctgcagtgccggcatcccatatgggtgctggttggggtcctggctgttccactttgaatccagctctctgctacggtctgggaaagcagtgaaggatggagcaagtccttgggcccctgcacccacatggaagacccggaggaggctcctggttcctggcttcgaatcagcgcagctctggctgttgctgccaattggggagtgaaccagcggatggaagacctctttgtctctctgcctctcctctgtgtaactctgactttccaataaataaataaatctttaaaaaaatacagaaaggaaactgaggtttatacagtattggtaatttgttcaaggccaagttaaccgggctgtggcaaagttggattcaaagtcagatcttcctgcgtccaaggcccctcatcttccctttgcacttttatgagtatgtttaagtaactgtaatgaagatatttttctgccttccttgacaatttgtcactgtgtcgaaccatttcctttttttgaacatgctgagtaggaagcatgggatggtggctcctctgcctctaacccctggctggactgtgttctcgtcccactcctccgcggtgggactgcacgtgagccagtcccttcattctcccatcggtgttatggagacgagcgaggcagtgactgaatgggaatctggggaggaaagttgcccgcccccacggttgcagctcagctacacctggctcctccagtgtggctcatggaacctctgactggaccctcacaccagccctgtactgagaaaagtctgtttcgtttcttcttttgccaagcccatctgggcagagcaggtgcaggggtggactctcaaaatagagtctgtgttccgtgtggcgtggcactgtggaaaccccctcgcagaattcttcacctgttgttcacattaaggaaatgctctctgtcctcatcatggccttctcctgccttctgtgtgaccttcattgtcagttgacctttctggtttcttcattgtaaaatgcaggatttggccacctcaagatccctcctcgttttgatgttctgtgccctcatttctgattagggctctagtttggaatccaccatctctatcttgtttaactactccagcagtattattctagcaagaatatctgaggttaaaaattactctcgatggttaaagcatattgtctaccacttggtatgccatttgctgtgtaccagccaccctctctcatgctggtgacaaatgccacccacaggcttgcctaagtcctaatgtgtgtgcttagggtcacagaaaacaataggtgacttaatcttatatcaaggaaagaagcttccataacaaggatactttcctttttaagtattaaatattcctcttgaagtttctaaatcttaagagattgactttaaagaattgatatttattaaaatcctcagacttttttttccccctgatactcaaacttaggacctgagccttactctccttctctataattagaaataataataccttcttcttgggcttgtcatgagaatagagtgataacaatgatgtggcactgtcagcaagtgtctgacatctactaggcacttgggaaatgtttgctggggaacaaatagtgtgttcagttttctgtgctgtgaatgctggctgttgattaaccttgaggctggaaaataagtttaagctaaaccctttgatctaaggtagcaatgttttaaaaagcttatttatttatttttatttatttgaaaggtggaggggggagtgcgagctttggtctgctggtttcctcttcaaatgactgcagcagccaaagccgggccaggctaaagccaggagccaggagctcctttcaggactcccatgtgggtgttaggagctcaaccacttcagctatcacccactgtctcattggattgcattagcaggaaactggattggaagccaagtagctgggattcagaccagacactctaatatgggatgcgagtgtcccaagaggtgggtcaacccactgtaccacaaggcccatccccaaaatagaaatattttagatgagactaactgtgagtacatatgaaacaattaaagaagaggaagtcaggataagatcactcgctgcattggctaacatgtgccccagacagaagaggcaaactctcacaatgagtcaaaattttcaggagagttggatgccagcatagctgatcattctaagaaaaagcccagaccataggtaatattctaaaaatacggaaaagactaaataattgatgcaccgttagtaagaagaaatgatgtgcatcattcaaaattatcaatataatagaaatagaaaaagaagtgccgtgagaagttgaacccaaattgtggtaatgctatgaatgaccctgtggctctgtgtgaagatatagaataaattttagaaaaaaatgtgatgtgaggaattaaaataatacatacactagggtgatggatttatggatgaatcgcaagatcatttcttttgttagacctttacttttaataattgaaataaaccagatattttaaatgattttacatggaataatgacatggattgaataacagatcagtcgctggggcaagatttttctctctggaattcaacatgatctgtgctttgaatgccttgatcattttattcaaaaggcagaggcagagagagagagagagagagatcatccattcactggtttactctctatatgcccacaacagacaggtctggaccaggtcaaagcagaaggccaaaattcagttccagtctcccatgtatgtggcaaggacccaagtactagactcaccgtctgctgcctcccagggtgcacatgagcgggaagctgggaagtggaccattctaagcttgaaccaggcactctgatgtggccactcaaccactgtgctgcatgcctgccctggatttttattaagagaaaataaatgcacaggtccagtaggtgatggacttctctctccaccatttacatttttgaggatctttcttcccagattacctgcaaacataacattgaatccaaagtaagggagaggccccgagaactctgatggctggcctcaggggtttgtcctgctatgtctttagaaaatgcccagttctctcaaaaatcagtcagcttaaaaagagccatatatcccttcatgcaaaagcaatataccggccagcgctgcagctcactaggctaatcctctgcctgtggcgctggcacccctggttctactcccagttggggcgccagattctgtcctggttgctcctcttccagtccagctctctgctgtggcccgggaaggcagtggaggatggcccaagtccttgggccctgcaccagcatgggagaccaggagaagcacctggctcctggcttcagatcggcatggcacgccggctgtggtggccattttgtgggtgaaccaatggaaggaagacttttctgtctctctctctcactgtctaactcagcctgtcaaaaaaaaaaaaaaaaaaaaaaagcgcaatatatctacttagcaaatggataattcaaaagatgatttaattttactattttttaaaagagttatttattcattttgaaaggcaaagttatagagaggcagaggcagagacaaagagaggtcctccatctgctggttcactccccaaatggccgcaataggtggagctgggctgatccgaagccaggaacctggagcttcttctgagtctccaacatgggtgcaggggcccaaggacttgggccatcctctactgctttcctaggacacagcagagagctggattggaagtggagcaatatggactcaaactggtgtccatgtgggatgccggcactgcaggtggcagctttatacactacatcactgtgccagcccctaatattactttcacagatggacacttcacttaaaataaaagtttctttttaaaaaaatttatttatttatttgaaagtcaagagttatgtagagagaaacagagagagagagaaagagaacttccattcactaattcactccccagatggctacaagagccaggggtgatccagaccaaagccaacagccaggagtttcatcaacatctcccatgtgggtcatggtgcccacttgggccatcttccactgcttttcccaggccattatcagggagctagattggaagtggagaagccgggatgtgaactggtgccaatataagatgtcggtaatgcaggtggtggccttaccagccatgccacaatactggccctacaataaaactttctacaggatacaattggataggaggaataatttctaatgtttgatggcacagtagtataactatgtttgatagtaaattgtttatttcaaaatagctagcagaattttgaatgctcccaacacaaagaaatgataattgtctgagatgataaagatgtcagttactgtgatctgataaatgacatggtaatgtcatgctgcacccccataaatatgtgcaattattatgcatcaatgaaaaaaatttcctatgaacttcccttgaaaatgttttgaattttcaggaacacattagctccatgcagtgacttcctgtgtatgtagtaatatattcttagggctggcctttccacagcttgaatgtttgggtcctcgttaaggggaaaaaaatctgatgagatgcaacacaactgtgaccttcggtgatcttccagctctcaatctgattcaagtcacatcagttcaaccttgcataagcaccagtccagtactacttgatccaatccagccaggcttagaaatgcttgggtgtttgtgccagtgaatctaatgatcaaagcattgcctctgaattacaaaagggtggctcatgttgtcccctagtcttccttgcaaccacaagaaagcccgagaccctttctcactgtgtgtaccaatttctcaaggcctcctagtctaagtttgcttggcaacgtagaggaagtagaaccagacagaaaacctcaagacctgacttccagtctttgttccagttcacctactaatagcattgtcagtcaaccgctctaagcctgtctccttatttgttaaaatgaatagagtagtctggtttttctgaccactttttttttatacaaatcttttttttattttttaattttttaaatttatttgacaggtagagttatagacagtgagagagagagacagagagaaaggtcttccttccattggttcactccccaaatggctgctatggccggtgccgtgctgatccgaagccaggagctaggagcttcttcctggtctcccatgtgagtgcaggggcccaagcacgtgggccatcctctactgccctactgggccacaacggagagctggattggaataggagcaaccaggactagaaacggcgcccatatgggatgttggcaccgcaggcggaggattaaccaagtgagccatggcaccggcccctttctgaccacttttgtttagacctcgcagtctatgaattcaccttcaattcttttatgcaattttttgactgatttttttttttaagatttatttaattatctggaaggcaaagttacagagaggcagaggcagagggagagagaggtctttcatctgctgatccactccccaaatggcccacgtgggtgcaggggcccaaggacttgggccatcttccactgctttcctgggccataacagagagccagatcagaagtggagcagtcaagactcaaactggtgcccaaatggtatgtccatactgcaggcgatggctttacccactatgccacagtaccaaccctgactaattcggatctagtcccagtccctttgttactgttagttggctcttctcagagcaagagtgctcagtttggagcattataatttttccttgtttgtaaaagtgtttttggcaaggattgtgtgtgtttttttgtccccacacacagtctccttgagatgttgtgttacccatgagctaattcatcactatgccctacactcttggggtccttgtcagacccttctcaccttgtttcctcatggtcctatttttgttttgctttctatgtattaaacagttgtgactcaagagtaaaatgttaccaatatttttactacaaatctgggattttagtagatttaatattttttgagtaaaatttcataaacaagtttttttcaaaaatatttattctttttattaaatgaggttgtttgacaaattggtctggcaacacacattccccaaatgttttctctgtcaaggctgactcaataacctcctgcctatcccaaagtgaattcatcctcttgactctaagtgtccattgtatgtgcataaagtggtgagaatggccatgatgctggggagggggtggtgttggtggacttggattagattatctgggatcatgagaaatggaaattcatttctagctggctggctccaaaaggtgcagtctcatctgtttatgaaatatgctttggagttcaaggcaacatagagcaagtttgctgtgcaaagatggcagaagaaccagaggagcaacccttgaagctcacagttggcgagtgcgttacaggtgcagcagggctgtaggaggcctgcatcatccgctccaatgatgttgttccagatggatagttgtgtggagcaaaaaggcttgaaatcagagggcaggtacctgggagatagattttccacttaggcaagtctctccatctttctggtactgatttctcatctgtaaattgggtcacaacctatgagttggtgcatccagaaaacaaacataactacatacagaaaaacagcccctataaccattctacaaacttacattaaccattagcagtgtatttattcactcactcatttatgtatccaacagatacctgtatggccaagcattttagataaacactgagctaaaaataaaaatgtgtgaagatcaaagtgcaaaaattctagttcaagttcttagtaagtggtagatgaatcataagtggaagtgttgaagtagacagtgcctttctgtaggtctttcagctgcttttctggtcttcaaatgctttgccgcttagtttccaaaggaaacagtgccagcctccatgtctttctccaacttatctttattattttgtcttctttaaccatttctgagatttacttttattgtacacatgatggaattagattatcaaattaattttgtaaacaaaatgctgtatacattcacaccccagaatattttatatttctttaacaatataagaagagagagaattttaaaaacttaggggaacatagaagcctggggcttattacttgcttggatcagtggtcctcaatccagaatttcatcatgtctagattattatgtttggtgggtgacaaataaaaatataaatggggaactgatatgtggacccttgagtctgtaaagtagtgaaaattgaataggggtaggctggaggtccttctcattttagttggatctggagaacagatttgagctttctttttggtgacagagaatcttaaagggctcagggtgggtgtttctggatggtgctgcaggcctatgaagacagggtttgccatgtctttcctctccttgagtctttcttccacctcccagactctagaacatggaccaggttctcataaatgtctgtaagatgaaggaatccgggaggacacggtggatcaggagttgtaagcgactgggttgagtgtgttctgattcctcaagctctttatctgttttcttactctccttcatctgtaattttagctttcttttccctgtttgtttgcacagtgaagttcctcttcccacccctgcccctccccccagatattctagtcatttgaggccttcagtgactgtataatcccttacttgcccatgaactaattggtggcccatgaagctccggaagattttgggatgtctgagattccagagcctccttctcctcagggatacgaaacacacccttaactcactgtccttttggccgggaagaaagttgggagttggatcacttgaaattatatgctgatgactggagagcacatttctctttcttttcagtgtaaaatattgttttttttttttttttgaaaaatgcatctttcaccttaatcctgtaatgttttgtgggttccattgtgtcagaagagcaggatgggagtgaggcaggaagtgagctgaactgggctagatccttgggttagtgggtgaagtgctgtgtcaatgaatagtgccctcatgttgtgcctcagtttctatatatttcagatggagagatttttctcatctttacatgtgaaatagacaattatgaatagaaagactgtaatgtgttattgcatattggaagaaacaatttttaaaaactttaaagaaggattgcttatggaattaccatagggggaatagccacagagcccaggcatggaactcaaggacctgttaataattaagaacttgagaagatcctggattgagcatgtactctgtgccatgctctgtactaaatggattctacatatatttccttcactgctcacagtgatgctgagatagaggtattattgttactgctctgttatagacccagaactcaagagcaaaaggaggtgagtttcttagtgatggattcccatgcgggagcttgctagcccacaggtacctggccagaggactgtgaggtcacctttggtgtcaggtgttgcctagtttggctaatgtgtgagcagaatggtgaggacatgcatcttctctgacctccagcatgtttaggtgtcttcctgtgggtttctagccctcaacagacatcccatcctctacccccttgctccatgtcacaatttctggctatttatgcccactctagagctgtttttgtcaactctattatctgcaggacaaaacacacagccaggcatg

SEQ ID NO: 106 - DNA, 5940 bp, Oryctolagus cuniculus
gttctgtcactaagtgaccggaccacatcatgtagtctctgatctttaagtcacttcccgttaaatgaatatttgatttctaaaatccctttttaactctatgattcactgatgcagtggctctgaaactgacacacttgaatagtaattactaaggaactaacactgttttattattttttaaaattttatttatttattaccagctatttgaaagggagagagggagagacaaagagggagagaaagacagagttgggggagggagggagagagggagaaatggagagagagaaggagaggaagaaagagagatattttccatccactggttcactcttcaaatgcctacaatagccaagtctgggccaagttgaagccaagagtccagaacttaatccagatctcctacaagggtggcagggaccaaagtacttgagccattacctgcctcccaaggtgcacattagcaagaagccaaattggaagtggagtagctgggattcaaaccaggcacgtcaatatattatcagagtaaagacatcacaagttggtatgtgctgagtcactaatcaatatacagggtctcctttatgctgatttttgttttccactttcatcatcaacattttattatataggttggagatttttcttttctctgattcactccccaaatggctataatagccagggctggctgaggctgcagccaggagccaacatctctatctaggtctcccacctgactggtagggcccccagaacttgggacattcttcagtgccttcctagctgcattagtagggagctggattggaagcagagcagctgggacttgagctaatgctccaatatgagatgcaggcatcccaaacagtagctgaacctgatatgccacaaaaccacccccaggttcaggactttttttcattttctcttgaacccatggtaaaataaaagatcgaatatttcttgagaaagattcttagggaggaaaatccttattcctatccagtcccactttctgatgaattttagaggagttgaccaaggtctatctgttgctattatatatcaggaatagctttgtgtcccatcctctcctctctcagcttcaactgcccacatccttcacttgctcacttcagtctacaaggtcttcctgaatttctaaacctacaaaatctcacaatgcacatttctaaaaattagttactatttattgtggtgggtatgaaatgtcttttttaaactttgtattttaccttttttaagatgatatagtcctaatttacattatagtcaaaggcttagtgctccaagaatacactggatttgctggagaagtcatgagccactctgaggacatctgtggatttccgtgcatctgaccctgaatgctcctttcttctgtgactgtggatgcactgtctgtgcccccagctccacttccacctgtgactcatacactccctctcctctacttcctgcagcaccagatactccctctctactaggtcatttcaccagcgttcagaatgctgtcatttatctcaatttaaaatattctctgtaggctctacttctccttataatctcatttctctcctgtgttctaattctctctctctctttcaaagaattgtccatgtggtctccaagttttcaacttccactctcttttctcccccaaagaaaccatttatttaatgagtacaaatttcataagtacaactttaggaatatagtgattcttcccattatacccgccctccctcctcactccctccccacctcttcctccttctcccattcccaggcccattctccattatccactcttttgaacatttctgatcagacttttgtccctgctgctttataaaaactactgccatccagttcactggtgactctcacgttgttaaatccaatggcccatttccattctcaatcttagttgaccagtcatcaccagttgacacagtgggtcactcctttataatttttcttctcttgtatcctaggacaacaccattctcctccaaggccagtcccttccaaacttctttttcttctcatcttgctgacttcctaatattggagtgtctccaagctcagtcgttggacttctctgtccatactcatttgctagacactctctcctagtcccatggccttgaacatagctgtccccatttgaacatctatgtccccagcactgacttgtgcacctgacattctccttgggtcatctgacaggcatcttagacttaacatgcccaaaacagatctcctaaacctccagtaatcaagacaaattctactgggataagaatggacaaatatatcagtgggatgaaatagagagcttagttatcaacccaacttatatggccaactgattttcttaaacatttatttatttatttatttaaaaggcaaagagagagagagagaagaagaagaagaagaagaagaagaagaagaagaagaagaagaagaagaagaggaggaggaggaggaggaggaggaggaagaagaagaagaggaagaaaaagaagaagaaaaagaaaaagaaaaggaaaagaaatatcttccatctgtttgttcattctccaagtgtccacaagggcaggggctgggccaggctgaagccaggagccaggagcttcatctgggcctcccacatgagtgcaggggcccaagcatttgggccatcttctgcttcttttgcaggcacatcagcaaggatctggatcagaagtagagcagctggggccagcgctgtggcacagtaggttaattctctacctgcagcaccgacatcccatatgggtgctggttctagtccaggctgctcctcttccaacccagctctctgctatggcctgtgaaagcagtggaagatggcctaagtccttgggtctctgcacccacatgggagaccaggaagaagtgcctgaattcggatcagtgcagctcaggccattgcggccatttagggggtgaaccaacagaaggaagacctttctctctgtctctcactatctgttactctacctctcaaataaataaatgaataaaatctttattaaaaaagaaaagtggagcagccaggacttgaactggtgcccatataggatgttggcactgcaggtggaggcttaaccttcttcaccacagctccagcctcatggctggttgattttcaacaaagatgccaaagaaaaccattgggggaaaggaaagtctgtttttatttttgttttttaaggtttatttgtttatttgaaagctttatgggcagggtggggggagatgtcttccatccactgtttactcctcagatggctgcaatggccagggctgagccaagcaaaagccagaagccaagagcaacatctggtcttaaaaatgggtagcaggggcccaaacacttgggccattctccactttaaatggattaattgtttggactatgtttatattttgattaaattgtaaaaaaaccataaacctatgaaatttgtcttgagaatagtttggtttaaccaaatatatccaaagtagattactatctcaacatgcaatgaaagtagaaagtatgttaaatttattggaatataatatatatatatattcatagtgctaagtcttcaaaacctggtgtgttgttagacctgtagcacaccacagtagggacagcctcatccccagagctctagagcacgagtggcagccattctcggcacaggtctagaatccatgtgagttaattccaagttcaatcatttgggactgaaagatgataactgaagaacatgttcaaggagtgaaccaggaactagtcaaattgagctactccttcttatttctaacggtgactaacacttctggatctcttagtatatacaaggctggtgctcaaccttcgcatgaattacttctcttagttttcacagcagttttaccagttagacctcccccactctcagatgggaaaatgaaggcacaaaagtcaagtaacttggccattatgactgttgagtatattttcccttacacaaaatgatgtgggaaatttataataacacaaatcacatttctccaggctcctgcactgaaaaggagggggaaatagaggaggaaaactggattccaagtcactgaaggagggaagctggtttagttacttctgcacctctttcagagggcaggcgaaaagggtgctgagtgaatgcacgctgggcgggtgagcagataagggggcacagagcggtgggcacatagaagggggacggtgctctgtgtgcagccctcctcccacaatctttcctacatgggatcacaatactgaacaaggttaatctctcccttgttccattgctgatggtcttttccatcctgtttctatgtatgggtgctcctggttaggtgggtaaaggaggagaccctagggaggtagcatgtcctactccctgttctgcatggcattccagtgctggaaagaatagtgtagggctcaagagagcagaattgggcagacagggtttgatcccaggcccatgcctaccagctgtgtggccttgatctgttactcattcctcttagtctctcttatctgtagaccccgtgtaaggcaatgtttatgagaacttactttggagtataatgaaagcacaaaacctaattgtgtactcaatacattttcagagtagcacacaccacagtgaggactagaacatcaccaagaccccagcagccactttctgtcccccaccaggcaccgcctcactccacacccccagccaagagtaaacttcatctcaatttctaattcaatttttaactagttttgaacttcctatggatgaaaacatacacagtgtgtcttttgtgtttgggttcttgtgcttaacatcatgtttatgagtcacctatgttattagggatagttgtagtttgttaattctctttattaaacagcattctaatatgtaaacatatgacaatttaacagcccattctactgttggtagacatttgagttacttccaatttttgacttttataaaggaagttgctctgaacattcttgccaaagttcttggtggacaaggaccctgagtcacctaaatgatggttgggttatggaatatgaacaactgttggctatagggagcctgcccaatattttaactaatgcttttaacctcacagtgtaatgagaattaattaggtcatggaaagtgctcagtataatccttgtaatataggagctccttaatacaagtttaaaaatgtaatgaaggtgtaatactccatgaagcccaagccccatagtgtgtctgaacatttccctctgcttattcagttaggttgtttgcattgttttgttgttgtatatcatgcttccataaatgactttcttcatagctgttttattctgaaaatctttgttttgggaaattggcagggcaggttggattgactcgaactgtataactgtatgtgactgtaagaacactaaaggaggactctggggctcgatgaggggagtgagacacgaagcaagcccctcacgtgtggtcggggtcggcggtgtgaagacaggggcctgtgggtttcagggagtggtgtctcccggaggacagcagggcagggtgggatggaggatgaaatggcggtgactttagggcaactgggaaaccatgagtaataaccattaaatgaagaagcagagagaagtcacaagtgcaaagattcactttattcatccatctcaccaacattcgcaaggttaaagccaaggagggggtgagggccgggaggggaggggctggaggactgtggtgggaatgggtccactgaggggagggagcggcgaggctgggcctcagggtcactggcggtgccctggcaggcgtctcgctc

SEQ ID NO: 107 - DNA, 2974 bp, Oryctolagus cuniculus
ctgaggagggaagaagcacagagggcaaggcttaggtaccagtgggcatctcccctgggtgccatgtggatgatcacagagcgcattagggatggacagacagaagcagcccaaagctgttgcaatggggcagcgagcagacgtagaatctggatgactttgtttccctccgggttccgcctgccccttcagaaagtctatgttgttgtgtgtgaactctctgacccactgggaggcctctttgttgttgctctactctgcccctgcaatgactcagtgatcggggaaagaacacagcccatttcatctgacccctttggagtttagaagtaggaacaggtcccggccctgtgtcctaggagaagacggggacagtggcagagcaggcagcgagcgtctaagggaagcctctctcggctttcatttccctggtctcccccaggaccgggcagtgatatcaggactctctgggccttccttggcgaggccaggccaacccaccctgcagagtgggccttcagcctgtgtctgcacccaccccttcagcgcctgaggtcatgccagtgactctcctaccatcttgaaggcctcacagtgagacctgcacctggccgcccgttcccaggccagcctgtttgcaggaggactcgggaggggtcagctgtaagctgggtcacctgcctcacaggaactggtgagcttcactcctgaccgcgggcagctgccagatgggccctgggaaaccccgctctgtggggagtcagggcctagggtgggagagcatcgttaaaatgaaaaaatcaagaatccttcctgcgacaagtcagcagacgctcggacaggcttatacaaagctaacccccatggtaaccaagtagttcagtgtaagacagtgaactttcctgttttatgttcctctttgaatcttcatgattagccccccccccccataactgtatacagtggacttggcagcacagtactgtgatcgagcccctgagcagggaagagcggtctgtgaagaccttccgcctgggcagtcctggagagctttacattttccatctggcgttcacatcttaaacaattagcaatctaatctttaataataaattttaatttaattaattctaatgtaaattaaatttaattaattttatgtatatataaataaatataaaatgtagaaataatatattttatttttaactattataaaattattatattaatcttattttgatttaattaatttttaatataaaaattatttcaagatgcctcattagcttttaataaagtttaaaagtctctaaaagtttttaaaaggctctaaattaattttaaaatagtttaaaacagtttaaatcattttacataggtttaaattagtttcaaaagagctttgaaaggttcctaaaatagccctagcaagctattgcagaccaaaaaaatccttcgtaaacatcatgtttgacattagctggggtgcacaacagcaacaacaaattattaaactattttagaggccatgggattaaaatatctagatttacgtttttctgtcacagacttaaggtattgaaaaatacagttatattggtttttgttaactgcagttatacatgagcagatattttatacaactgcaatgtcatcctgcccaggcagctaaatctttgaaattagcaacatgccacgtacttgccttacttttattagttaatacaccttactggtatttaatataaatttagtgaattgaccgagatctgagtggccagactgttgccattaaacttgattttttgctggtgtggtttttaccataaaagaatttataaatatgcttctttcttttgaactgagctttcataatttaaataaacatgataagaggatattgaaataatagtacatcattctttatagtcccctaatggaagttttcagtaagaggataaaatagcgaacatggattttgtttctgaaatttctaagaagtcccctctgccctgtttcgcccatgctggctccgtgtcctccacagtctctttcccttagtggcattatttgtatcactgtgtgtcaggacaaccggccactgcagagttagacaggctcgtggcggggctgctgtggcctttagcggccaggcacacggccccacggagctaagtggcacggccacggaaggcattcagccatgaaaaagaccgccacgagatctacagaccacgccagttgtgccatggcctctttggcattataaaaatatgacaaataactgaaggaaataaaagaacatatagttcttctttaaatacttaaaatatttcttattttccttcaaatctatgatcattaaacaatgcattccttcatttaaaccaattttgatcgaaggtcatttcaagttcagtctaatgtggaaattggactttttaaaaagaagtaggctgtgaaggccttactcctgtagaatcatagtttatcactcactgtggactctaaaaattatatcgctgccaagctctccagaaagtcatatcttttacatgtaaaataatttccttttctaacttcttactgtttttttagtgcatgttattgaattttatagttgctatagaataatatatcagacaaaagaggaaatagactaaaatacatttctctatttttcacacacaatgagcaaaacaccgtaaccaacagtatcagtgaagctctttagagtgccgagggctcccttacttatctacgctaatttcttcccctttgagtcattcaatatacagcaattaatctttttgccgctaaattcatttaacttttgcaaccaacaacatatctcaaacctactcatttacccacttttataaaatttctacttaaaagtgaatctggccaattagagcaaaatttcagacagtaataggaaaaaggtacttacgtttgatctccagcttgg

SEQ ID NO: 108 - DNA, 232 bp, Oryctolagus cuniculus
tcaacaaaaacctctgactgctcccaagctcattagactgacagacagaatttggccactcgctagctctttgctctctacttgagatgaacagatattctgctccctacccatccgtgtttttggaaaaattccattcccctccggattgaccttaactcatctcccaaatgcgcaaatcccacatttaccaactcagtaaggaaaaggactgggaaagtgcacttacatt

SEQ ID NO: 109 - DNA, 245 bp, Oryctolagus cuniculus
actctgtcatcccacccctcacaaaaacctccctttgcggccagtcccaccacacggcaactgtagagaaacttctgctgtttctctcctattctcccaaacccccaaatttctgtcttctccgcttttgattattttcttctatttacttttggggtcgccaggaatggctcatttaactgaaacatcacaaacttgcccaggtgatccaggggaccaagacctcacagttggacagaaaggga

SEQ ID NO: 110 - DNA, 245 bp, Oryctolagus cuniculus
acggtggctccctttaccttctccctccacaaaaccctccctgacaaggcggcaagccctctccccggggaagttattttgacttggaaatctcagacagttttccctcctctgtgcctcatcttggaaagaaattcgttagaaccctgacctccagccaacaaagacacacaaacagcgaaaaagtggaaaaaacaaaccaatcaggcagaaacggtgaggaatcagtgaaacggccacttacc

SEQ ID NO: 111 - DNA, 339 bp, Oryctolagus cuniculus
cacagtggttcctcctaacctccctcctgtacaaaaactgagtttccctttctgaccatcaggcaaggctccgcccagaacacatcaggatgcaccccagtgaatttctgaagctctcaaattactctctctctctctccctctctttctcaatgactgagtcttgctcttcgtagacaatatgcagtccttgctcaagcttgccacacacttcatccctgcattgcctggtggatgctcccgattggtttcagagtcagcttagggatcgcttcacagacacagagatcacacgacgcagacaaccagagagggaacgtttggattttactcacgttt

SEQ ID NO: 112 - DNA, 19361 bp, Oryctolagus cuniculus
acacagtgacaactcctcattgtacaaaacccttctcacccaaggggaaccgagccctgcctcagctctgaggcctaactccctctctgaacagaagccctgaggcttctctgatgcagaatgcttgtttccttaggtgagctctaagatcctggaagacagtatatttatgtctacatagtatgtttatatatgtatgtctatatattattatattatattatattatatattatgtctttctgccaccactaccccctccagagtgcttgttatttattttttggaaagtaggctgaatgtaaattataaagaaaaagacacaaataataatgataataaaaaacctcttaattgaactttctcctagggtgaggttgggaggatttgcaaatgatacacttttttttttccagtggaattgggaactcatcagtgtctccctgttaataatagtaaggaaagtctgcccatttgaatctttattgccatggtgttgtttcagaaagactaaatgcatcttacatcaagaccccccatcattgacgtgtagtttggaatttagctacagtgcaaaacaaaaatgaagatcaacagacagaagagcagccatggttgactggtctgcagtccaggtctcattgagccgaaccaggtgcctgctgtcttgggagctgccatggaatcctgagtaccacgaggtttctgtggacactccacccaggaccctgaagacctcgctttgttttgagttctgcttcatttattgcagtctcgcttcccctctaacttctcaccctcatccactctgtatattgcccccaccatcctggacactgtataccttcagtggcctccagttttttacaaaacactccctctgagtgttacctacctgaattagcctgtaaacagctgtcattcaagattcaactagaaacacgttttgccagattatacccaagcaggtggcctgattttgcagggtacagagacaggtcactgggcctagaacccccaattgctcttgtctgctatcagtgagtcttgaccagatgaggctgtaagctgtctaatgctttgtttgccttatatttgggagacttggtccaacatcctcacttttcaaatgagaaataaaagaacaattgaaaatcagaggtcagagatgacaaactataacagatcaaagaccaatactgtccattgcaatagaaagttgtacagcagaaattgtgtacgtaattcccatgattggggtagatttatgtgattctgtcactgggagctttgccagttgccttgaatagcagagtgggcaggagttcccaccagaagctggggagagaagaatggaggtggaggaagagagcaggaagaggttgacacctggaatgaagtgagcagcagagctgattgccaacacagtcagcttccatcccaagggggctgggaagtcgttttttctctgaagagccgggagcagcatccatcacaagggctggcatttactggcacttacaaagtgcagatattgtatgtgaatcgccacacttttcttctcacccaaacttcatgagctagaacccagcattatctcctatcttgtaggagaggaaatggagtgcagacaggtccagaactggtgtatgatgacaagtgcagtatctagaacctgaactcagagctcgtgtacatagctgagctttgcagaggtgtcccctagttggagcagggacatggcacaggacacaggggtagaggagaggcagctccttagcctggcccagagttgggaatgagtgagtaagtgaccccagatgtattctcaagactgtgcactgaaatgttgaaaaggtaaaaatatggaaaatgactaaaatagtcagaaataggaatttgagggagagagggaggaggagggagagagaagcagaaggagcgagagtctgaaagagaaagctgcagaccatcctgaccgctgtgggtaggtcatcttagcaggtccctcagctgtaactcttcccagcacccaggatgagccggcctctctagggagggccccctcacggcagcggcacgcagtgagtcacccagtgcatcagagacacgggagcaccactgtgccctctgcaagccctgagggccggcggcttccccacctggctctggactcctgcgtctgctgtccgccttccagtctgtggctcagcgttccccttgtcttctttccggttcctcaggcacggtgcactccaaggcaggtgattctgctccacgcggctcctccttaggctcctgacccatccttcagttgatacaaacagacagctcacggagggggccactctgtactccgcatccagtggggcttagcttggcactggttgatcgttcttcttctggccactgtgtcctgcatggatgtgctccaggctccccggaggcatggcaggcccagtagctgctgagaaagagcaggacggaggagttcctggaggaagaggctctgctttgccacatcagggctgcgtctgtttcggctgtctccggaggaagacctgctggcaggagcagagtcctcagcagtgagcaaacgcacgcaccacagacaccacccagagttctgcttgctctctggaccacgtggattctcggcttgtttccgtgagcacacaaaaggccgcaggtgctccagtggaagagccaacagcagggactgtgtcagggcttgcgaccagcagggactcagccaccgagatttacataccatgggctgtggttttgcagagtgaggagcccctcaaactctgtcctgctcgctcctccccgtctgcctgcctcaacccctttggtcttagagcagagaaacccactgggcctactactgtgtcgagctagctctgggtgcggtggtgagatctatggatttaggcttggttcctcatagccccagggccctgctaaccctggcaagagcctaggcttgtaacccaagagggagggtaggaagcggaccggcccacagaacaacgaaaaacacccacattgaacaagggatgacttgctcaccacattgcaacaagggatgactgagacttaaaaaaaaaaaaaaaagtctaatataatgaaggcctcactcttttgctctctcaaaatccccttcacagaaggagaaatatcacagtgagaattcatgtattttttgctgggagaatcaccaatggttctattagtagaaaaagatgttgaggaaaaaaaagaaggatttaaatcctgtgtttgaattgaaggagagactggaatccagaaatgtttatttgtctactgcaaaaacaggaggcgctcttgaagcagccagagctggttttaagcacgtgggagccatcagggctgggccagggggtgagggggtctggagggtgggacagcactggtccctctgctggcacggggagctcagccctcctgccccagccctgtgaacagtgatggcagcagaaaggggtaaggctaacaggcattcgataccgcacgtaaacttccacccagtagaagggaaaatgcacaaaactgaaaccagtgtgggcgggcggccgcagggaaagtctgcggcttcgcttcctgcacttggtggaggctctgagatcctgcctggactctgtgctgatggctcggagccccggcgtggccgcacagctctcggagaaacctttcctagacaggtgggtacgatgagccgcggacaggtgggtaccaagaacagctgctgtggagaaccccaggaggtggctctcgaggtggacctgaagcttttgatcgcaagggtgttagaagaacttgtaaatcatattcaagagccccggtgtggatgcaaggggatccaaaggaaagcagagcacaagcgtcagagctgtgctgggaaggcacgagagctccagaaaaccgaccaggttgcccccagcgtgtccaacgacgagacgggcgcattagcgatgcagcggccaatctgtgaccctgcaagattggccagctctaggtgctgtggccatttggggagtgaaccagcagatggaagattactgtctctgcctctccttctctgaaactctgcctttcaaataaataaataaatgtttaaaaaaagaatggagcatgctgctgtggggaagtgtactcttcctcagcgcccagtggcttctgtctggtgctgtgcctcagggacacaggcgggcagaggccaccttcagcctggggcttccacggtcagtcccaagacggctgagtctgagagaaacgtgcatctcacagtcagcgccatggaatcaggttggaaatgcagcccagaatggagactctgggcaggaagaggacacacagacgtgcacacacagagtaaaggcttccatcgctgccaaagagattttggaccataaggagagggtgaagtccgagtgagcacaaactctccaagtgggtcatgcagccactcgggtgatgtgatgtttatcttacttcctgtgccctgcctcgcatcatgaagattttactgacagtctaatcttcctacaagtcaggagcagcttcaggcgagtgacctcatccaggctgctgggtcttctccattgtaccttgaactctatttgctatgtcaaattgaagctacttggagatataatttagttaggaaaagatttgaataaaaagtttgagagagagagggagatatctcctatctgctggctcattcctcaagtgtccacagtggctggggttgggtcaggacagagctgggatctgggaatacaacccagggcttccacgcctcccaacactggagccattgtggctgtctcccagtgtctgagcagaaagctggagtcgggagccagtctcatagattcccatttttcactgatatttttacacctatatttgcatgatttccccaagaattttgtgctcttctctgaagaaaagttgtgtgatgggtgggcttctggtgcagctgttgagacgctcctcgggtgcccactgccgtgtagacggcctgagtccgagtcccagctcctgctcttgatcccaggttcctgccagtgtgcacccgggaggcagcagagcatggctctagcagctgggtccctgccacatgcatgggagaaagggttgagttcctggttcctttctttggcctggccagcccagccgttgtgggaatttctgaagagtgaaccagtgaatgggatgtctctgtgtttccatgtctttcaaataaataaaattataacaaattaaaagtttctttctgaacctcttctttttatatatgaagtggaagtttttggatggatgcggtatacaagtctttctggctttaataacctgagatgcttttcaaacagggtggctgaagagcggtgcataaatgtggccagtagagggcagcagcaggtgcttattccttttaaaaagttaccttctaatttcatctgtcaattgcacattgaacagtgtttgggctttttttttttttttctatttataaataattttaattttatatttgtaaactggaaagtcattcttcaaacactgtcttgtctctgggccatctcttggttcactcctaccttggaggccacgtctgctgtctcaagcgctggcgccttctcatctccttgtcctctgtactgagttccctgctgtgggtcagtcttacctcatctgttacacccaccgtctgctgatctcacccaggccagatggcgtccctgaacctcagaatcatacccgcccacctgcccaagggacactgccagttggtggtccagcaccattccccaaatctagtatgtccaaatgaaggccctaatttatgcctgtctcctaacgttgctttcctcagcctcccctgtgcgagaagaatcattgctcactttccagttgtgtgactccgagcgcctgcaggagcccttggtgctgcccttctcgaggcttacacaccgaggttttctttgttccacctgcagccatggccagaccctgagcaccttctgcacagcccagctggggctcttgcttggattcaagtgtcaaagaatgctacagggggagttttggtatctgttttggaagatgtctcaatgaccaagaaggatttggtaggcatcaagtgacccttaaatgaaagtcttcatttttttttccctcctcatacattgcactgggagtgttggggggggatgtcttaggttttttcagactaaggaacaagcttatcttagtgatgtttatcagtgtcatgagaattcggtgggggtggggagtgtagtatttaatcctggaactattaggatgcaacctcttggttgcttgcagaaagcttagagacaggattgtggtggatggtgaactttaataggtcttggtgagaaataatagataaagagaactagggccagcgctgaagctcaataggctaatcctctgccttgcggcgccggcacatcgggttctagtcccggttagggtgccggattctgtcccggttgcccctcttccaggccagctctctgctgtggccagggagtgcagtggaggatggcccaagtgcttgggccctgcaccccatgggagaccaggagaaacacctggctcctgccttaggatcagcacagtgcgctggccgcagcggccattggagggtgaaccaacggcaaaggaagacctttctctctgtctctctctcttactagccactctgcctgtcaaaacaaacaaacaaacaaacaaacaaaaaaacaaaaaacaaaaaaactcaacttgtgcgtaaatcccttggccaatggccattaatggcagtgggaagttgcctgaggaggcagccaacccccttccatgacaggtgtcgtggattctgcagttttctttcccaacaggttctccctccaacttgaacggcgaattagtcaaggttgttgttgcaagaacagaagtcagttttaacagaaatagaaaaggaggttaaaagtagaggactgatcagagcaggaacagtagttatagctggcagttcacagagacgctgggaggggtggagagccaggccccggctgagcacccttgacagtgctgctgggccagtcccggagcgcagctgtgctctgtccatgtctgggggtgtacccatgcgtgggaggctgcaggggtactgccgtcatcaccactggtgcactctgcccgccattggtggtcttgctgctactgctgccgtcagaaggagccttcttcactgagtttctcattagagggaagggaagtgaacacttggctgcacagtgtaccacaggggacagcgtgaagccatgcagcctcactgaacatcttcttggactgctcattttacttgaagtttgcatgcaaatattttatgttaaaattcacacacacacacatatagaaggcacaagttgtataatttctatgagaaaaagacacaacttaaaaaaagagacaagctttgggtggcacagaaagtagcggtggggtggggggcggtgctatgcacagtgggttaaaaccccagcctacagtgccagcgtctcatatggaggtccttgggccctgcacccacgtgggcgacctggaagaagctcctggctcctggcttcaggtcgatgcagcactggccgttacagccaattggggagtgaaccagcagatggaagacctctctctctctctacctctccttatctctgtgtaactctgactttcaaatacataaataaatctttaaaaaaaaagtagcagagaagaaggtgtttatttactttcctttgtgggcttgagaacaatgagcccctatcacagcctcctaatggagcgcagctggagtgctcacaacagtcaagtcacacagagattctgtgcagccgctgtgctgggctttgcacggagagagcggtgtgagaagaggaaaagagctcagattaggagctgaagagcctggtttagtctcagcgctgctgagcgggagaagacctggtgctctggcctcctgttccctgtgtctaggtgggagggacagagggcttcccaggttccttttgctgtcaggctctgtgttatgggggtggaaaaggtggaggagcagtgttgctgggagctgcagagcatccgagtggacagcagcgggcggggaccccgtggttcagaagaaagcccatcttcagtttcccaccaggtgcccactgtcttttttcccatccactaacagcaaatgttcacaacaggaaagctgggcgtcgtttaccgattgtgacgaacacatggatgtgagctgtcagctgggtgtgcagtggaaaggcactgtgtgtactgcttcacaattttttgatttgtaaatttaaagcgattctgaaatgggaaatttctttacacaacaacaacaacaaactgagtatcacagcaaactgtgaaaaagaaaaaaaagttcccctggcgtgactttagtgttcatattgtcctgctgcttgtctgcaggaggctgacagacatctgcaaataagaaatcagccctggaaagggttttttaaaattgtgtatgtatttatttttatttgagtgggagagagagagggagagagatcttctgtccattggtttactcccccaaaggccaggctgaagccagtagcccaggactccgcccaggcctcccacgtagatggcagggacccaggccctgagtcctcactctcagggtgtgcatgagcaggaagctggcatcaggagcagactgggattagaccaggcattcagtgtgcgatgggagcaacccaagggccaggctgatgccggggtcagggactccatctgggcctatgtgggtggcagcagccaaagtacttgggccaccatctgccacttcccaggtgcatgagcaggaagatgcatcagaagcggagctgagactcaatcccaggcactcaaatgtgggctgtgggtgttccaagtggcagctgaagactctgccacagcatccactctgcctaatttctactatttatttccttccagtgacttttggtttggtgtattttaatttttctatgtcttgagatcactgtcacatttttaatttgatgtctttcttggtttttgtggatgtgagtacatattgcattaaacttccctggctccttgttttggcctggcacagctctggccattgtgggccctctggggagtgatctctccttctctgtgcctctgtctctccctctctgtaactctacatttcaaataaagaaattaataaatcctttctgtaaaaaaaataaaaaaggcctgaggctgcaatctccctgcagccacttgctcaggggatactcccccctccctcagcttggagaatcccagttcaagtttatccagctcctcagaccaggagtcaaacgcagagcagtctggatgggctgcctcacaagcgactgcccgcttccaggtttcacacgtttcttatggggtgggtgcgtgcacttgtcaggtttaaacagcacagatttcagtgttgtcagttgagagtccagcaggatactggtaatagttaaggttttggtcatggattacatgactacactgcgttcccacacttgatgttacctatgtgcacaaacagtgagatcgctcatcattttcccacgatggccctgggctgtgaagcttcctccccttagggcgcagcagtcccccgggtcacagagtttgctgagaagctgtgctccttgggggactgactgaaagcaagagtgtatcagattacattagtcccaaaagtccaggaggggtagagggacgataatctgtctttagagctacttcctgctgacatggggtgatgaggtgctctctgctggcatggggcgatgtctcaagccgctgtctcctgggtgggagccgagtatatccctgtagcagcatttggttgaccgccgtgttgctgaaggccttggttcgttcccttatcaactcctgtaaagacttaaacagacacggtagtataaaagacagtgtaagaatagcaaacaatgatcctaagagtggcattaaccaggtaatgagcggtttcacagaggagaggaaaatggggagggggctctggacccttgtgagacctgtttgatggacgtggtttaaagctgatcccaagcaaccgggagaaaggccactcaacttttgcaggtagaggggtttgtctgtagggaaattctgaacaatcatacaacatcaggttggggagagaaccatcaatacacacaggtcaggagcagagccattgatgttggagtagaggctatgattatataagaatgaggccccaagtgggctagatagggtctagaacaaaggacagagtcattactagaggacccaagagagctgatgtctaaaccatgactaagttgtctgattaggaggcaatagaaactgacagaaggggcttgataataatcaggtgggctttaagaccttgtcagttgtgaggcccagatttatctctctcttcacatggggtacatcctaagggaggtgtgaacctcttggggaatgcaccctgttgacttccattacctagctggcctgggaggagagctggctgggtaaaggcaggtggcattcctaacaggaaacctacagttctgcctgcaatgttgctgaccctacttggccatcccctcagcagtggtggtcactttggaaactgggctgagtgaagggctcttcagcttggagccagcaagatctgtggctctgacctgggtgtccttcaactccagggcagttccatttccagagatccaactcttggctggcagagctgccagggctcttcctagctgacttctgctgaacccaggcttaccacactgaaagtcagtgcagtggactggcctgttgggtctccttgagggcagatcactgtgcagagctgcctttaattggcctgccacctctctttacattgtttctgatgcctagctttcttttcctcctgttttttttttttttttttttttttttttacagcagaccagagggtgcaggtgaaggaggtgctcatgtcccatctttaatctttggtggcctcaactagaagcctaaagtacaggcatgttctgatagtggttttccctgaggtagaccatgtccatggggaaagctatgtcctcactttcaaactttctctccctctgtttgctctgaaagggatgttttgcctgtttattgtgcccatggcaaagtaaatctagctgtgaaattataatttaagctttccttttggctatgctattacagaaatctgttagccatcccttttacaggtctaaaaatcaaattgtgcatcttggagagtctgtcggaatagagttagtttcctaccttgaagagaatagagaaatgaggacaagttgggcttagaatagagagatgagggagcaagtcccacattgcttactgaccatagcattatcaaatgaaaacttagcaaagaatttcaaccattaaatgacaacttagggaaacatttaccagaaggtccattgccttctataaattttaagaacacatgtgtcgctccccctcttcgtggaggaacgacacaggaccctgcgctgttctttcgtctgctcggccctccccgggtttgctgctggttcttcccgggttggctactatcccttccacctccgtggaagggcagttccccccggccgcattccccacttccgcaggggagcggcacactgccggccggctttctcgggggctgcacgggttcccttagatgttccccatagatgttcctggtgcatgccgtctctctcctcctttatagtcctcctccgccaatcccaactcggctgcccacacgccgagtacgctgctctccaatcaggagcaagtcctacagttaattggttgaactggaggcagctgtgcggaagctgtttacttctctcccagcgccatattgtgggagagcagatgcatagaataagtcctaattccagcaactcagtctagtctggtttgctccccacagatccccctttctttttattttttggcgttgatacgcgcctgtcttcggtgtcccgcggcactcactctgctctacttgctagagttgccacaggctcttacaagtcctataatcaggcaaaccgaatccgggtcctctcttcgccatgttgtgaggaggtttttaggcgctgatgcatgcctgtgttcggtgccctgcagtacatgctctgctctgctagaactgcctgcaggtgcttacaagccctaccagtcaggcaaaccgaatccaagccttctcattgccgtattgtggggagacttattggtgttggttcgtgcctatcttcggtgacccgcagctcatactctggttgaactgcctgctggtgcttatcgcctaatcaggcagaccgaatccaagccttctcattgcggtattgtggggagacttattgatgttaataacgtgcctgtcttcggtgacctgcagcgggtaagctgctagctgcctgcaggtgctcatcgccttgctaatcaggcagaccgaatccaagctctctcattgctgtggtgtggggaggccttatttttctctatttctctatctccgggtgttcctatttctcctattttacttctatcttccagcattcctatttctctcattttacttctaaacttctgtttctcttatccctgcggcttcccggcgcctcgccccgccggcgggttcccggctctgcgccgcttcagcccacgcctcatctgcgcggctcggctttgcgcggcttggcttcgcgcgctccgcggtctcgcacttaaccctttcgcgtctgaaccacggcctcgccagccccgttccctatctacttgtgccccgcacgctctctctgcacgcggcggcttccgcgagtaacacagcgtagcttacgtgtccgccactagcattcaatctaagttccccgggctagcctggcgaattcaacccagcatacgtctccgccccacggtttggcttcccgtcctttgctccccgggctaatcagacggatcccaaccaggctcacgtttcagcttctggtttcaacttttcgccccctattcccgggctaacttgagaatcccaaagtggctttcgtgtccgccttggcctgccccccgcggcttcaatttccctaacatttttctctacccggtatgtttccccaagctttcctccaacaatactcctccctcatttctccttgcctctccccacagtccgcatccgagtctgtttgttctagctttcactttcgctttcgaccttagagatttctcccagcttccccccgtagtccgtatctgagtctatgcctaggctttcaatagcttcttccggctcctttttcgtccggcttttccctaggctgtttgctagtctctccctccggtattttcccagttcttcccgtttcttccctcctaagtttcatatccgtcctaagtttcctatccgttctaggtttcctatccatcctgcgtttcctatccgagtcacggcaccattatgtcgctccccctcttcgtggaggaacgacacaggaccctgcgctgttctttcgtctgctcggccctccctgggtttgctgctggttcttcccgggttggctactatcccttccacctccgtggaagggcagttccccccggccgcattccccacttccgcaggggagcggcacactgccggccggctttctcgggggctgcacgggttcccttagatgttccccatagatgttcctggtgcatgccgtctctctcctcctttatagtcctcctccgccaatcccaactcggctgcccacacgccgagtacgctgctctccaatcaggagcaagtcctacagttaattggttgaactggaggcagctgtgcggaagctgtttacttctctcccagcgccatattgtgggagagcagatgcatagaataagtcctaattccagcaactcagtctagtctggtttgctccccacacacatgtatttggaaacatctcttaaatatctaacatggtgtagcttgtttaaccagcaaattcaagcacaaacatatagaaacctttttagtttctttctaccaactaagttaaaatatctgatacagagattcaggtcacatgaatcaaaatgtatctttgattaattttatcagtttaaatttatgggcaatcttttatctacaagccaataaataaagttcttaatgaattttcccatgtagacatacaatatgtatacacatataacaaaggcgatagtgaaaggagtggccgagagccgccataacaaatggccttaataaaaaaaaaaaaaaaaaaaaaaaaaaaaacagaaattgagacaagcaattccagaaacagtcctgggaaatggggaataaactaagttcacagagaaagcagatagctactacccagagataagggctactacccagagataagggcgacagaacatcctggtatgcacctaagccccctcccctgtgcttgttcaagcttaacaaaaaaaccgcgaggcacgtagggcacgtagccacccctttctgctcttcaatgaccccctccccatatccaagcttagacacgcagggcacgtagcccccccaccccccccgttcctcctcctcctcgacgacctcctccccttgtagttgcccaataaacttatgccaccctatggtatgttaattttgtggttttgccccttaaaagctgtgtgagatagctgctcggggctcctcttccccccgctgcttgcggcagccagcagagggcccttttgcacaaatgaaataaaactgcctcctgtttttttgcatcctctggtctggagtctgtgtttctggggtcgtcacaaaaggacaccgcttttggggtccttcaatagaacaataaaaccatttccacaatagctttttaaactcttcaactgttttttaggttaccattgatttggattactttctgctcttagttacctgaattaaccctgctttcttccaggtgggacctgtagtgcattattggcttcatctgtttacagagccatcccaaagtactgaatacagtagaagtggctgggaaaagtccatcagaacctatacaaaactgtgaatgacacaggactttaaatagccatgtttaaaattagaaaccatgaaccaacaaaaggcagttgtgtccttcacacagtagttttgaatgcacctgtagggttttacagaacatttaactgtttaggcctctgggcctttttcattaagataaccatcatgtctagtaacataagatcattagactttttaactttaggacatttttatcagtagcattttatattatgaaacttaaaatttagcaccacttcacatcttgacagtacttctaatataatccaaatatcctgattagttggtgtctctacaagatgagagacatatatcctttgatttttctagttggttgggcccaaactggaaaaataaaagtccactttactggaaatttcagagtccaaattctttggaactttgattttggattttttggaatgcctgtcaaggatgcccagaaggcttaaagtatctggttgaaataagatcctttaccattaggacataatgtagaccaaatctgatcattgttaaaaggcgattattcaaatgttttagaataagcgtttttaaatacccacagctcttcttaaaacactcagctgtttctaaacaattaaaatttaacagaggcatcaagagaacataatagattacttttgatggaacaaggacataagcctcagccattctccctcactgcccaaaggagataaactttgggatgtattccttgcccttgaaactcaattgggtcttacaccctattgccttcataccccaccctgcattcttttccaggttcaaagggcatcaccccccccccccccgcagtttctggaattcccctccctgctgccccctactcccaacccagccctagccctccttaaaaaggcccagcccctgggagtcttctgccacatgatccatcatgtacacacagaggtcacccacctctgcggatttattttctctgaataaattcggtctgtctgtaaattcgtgcattgcctcttctctaatctgcaatggaggaataaccaagtgagtcatggcactggccccttaaacccatctttaaaacagaagtctcagacaaaaaaaatagtgtaaggatttcgtgaaaactcctgagatgttgaatgtggaggcagctccagactctgactggggtcaccactccttgagctcttctctaggtgacagctccagagaagcagcctgcgggaattcctaatgcttcatgcacttacctctaagtctagagtaagtcccagtgaaacactggaaatgtatatagaactgttgctcttccatggttttatcataccaagatacatgaatttaacttactttaatgcaggcaaagcatctaatttttgtccatttaccttgttaaaataacattcctctcatacatactgatttcttgacccaaatggaaatattaaccttaggtcaagatgggagagagatgactacaataaaaatgtctttactaaaataccacatgcatacacacaaatgcagaaagagagagagagagagagagagagagttttcttccatctgctgttacactctacaaatggctgcaatggccaggtctcccatgtgggtgccagggcccaatcacttggtacatcttcagctaattttccaggccattagtatggagctggattcgaagccagcactccaactggtgcccgtgtgggatgctggcattgcaggggtggctttatccacaacaccacaatgctggcctgtcgtgtatatcttttaaaagcatcatatgctccatccttcctcactcccaccctcagtgctcttcttttttaattttaatttaatttaattttaaaaggatgtatttatttatttgaaattcagagttacacagagagaagagaggcagagagagagaggtcttccatccgatgattcacaccccagttggccacaatggctggagctgtgccaatccgagccaggagccaggagccaggagcttccatttctcccacctgggtgcagggcccaaggatttgggccatcttctactgctttcgcaggccatagctgggagctggaacagaggtggagcagccgagattcaaaccggcgcatcaggccaggacattaacccgctgcgccacagagctggcacctatttgaacttttgaaagacttactttcaatgtactttataaacactagctcagccctccatatatacaaaattcaacacggagtaagcagaaaaccactgttcttcatcctaaagacaaggctatgcttctcaattcccccaatcccactgtcactaccagacctgaggtgcacttccgccccctgggggtcataggtggaatcgcgtcagctttcaatccctgatagagcagttcttcatttaatctgaaatcaaatagaaaattctcatggaattgaaccaatagtaacttcattgtttgctcgcaatggcacacaactaatggattcacatctcttgtagatgtagactaagtggaaacatcgaacagagcccttcatctcacagatcttccatggtagtgggcagggctgatggtactcaaaccaacaatgttctacctctgctcctgatattggaatttgaccttccaaaaatataatttggggtgccatacgatatcaccatatgcttattaataagttccccatattaataagcccatgtgggttcttgcctaatattcagagaattccacatactggcataagtgaacgaggcagcatggtacattttaagcatttattcagtgagaaagatgcataggagagtgagggccccgtctaaaggagagaggtaaatgtgggttcataccaagtaccaggaaccagccacgtggaggaacatctaggccaggaagcgtggggcgggtagccaaaggcaacacaccatggaggcacagggctgcagccagccccctactggcaagaagccagtgagagaagggaggaaaaagggcagacacaccttgtctcaggcttttaatccacttccaaggggagtggttaattcacctgattgaccggtgcccactcaggtgtggccagcagtggagcagtggggaatcaaagcagtctctgatgtaggctgctggctttgcaagtggcagctcaatccactgtgccacgatgccagccttccctcctctctggattttcttaagacaaacgtgaacgtttctgaagaggagagagagggtagtatattttcttgatgttcctcagacctatgatgaagcctagaattttcacttcttttttcgttatgcaacctgatcagaactcaggctgcaggtgggagagcgcacctgcgtgatctctcctctaagcacccccgtctccttctgagtcctggtctctggcagccgcttattctgagtcagtacagaggtgagtgtggacagaagtcttgaatctcagagaccatctccctggtgcagcggtctgccgtgaggggaccatgtgagggcatcagaacacaagtaaagaaatggccttaggcataaattagtttactatctattttaaagaaaaggaactttctcctacagatcccagataaccatgaatttattacaccatcttgtccaataaactcacaattttggcaactgtccctcagggaatttgggaggtgatgtctcctggtagaagcatgcacactgcaggtaaacgtgtgcagccctggtctgagctggggcagctgagacacagcccctgggctgagttctgagctgccctgggcccttcagctggcacagcccggccccgcccctgctcatttgcatgtccccagagcaccgcccacctctctgggcatttaggagcaggctgctcccaccccatgcaggaggcagtgccaggcaggacccagcatggacatgagggcccccactcagctgctggggctcctgctgctctggctcccaggtaaggaaggccagcagcaggaacggcctcgggcagtgtggccagggctgcccgtctctgcaggagcgtcctcttagaacgtgaggatgagtgtggtctctgtgtttctgtttcccttttcagg

SEQ ID NO: 113 - DNA, 15050 bp, Oryctolagus cuniculus
ccacagtgatacaagcccttacaaaaaccccccaggaaagcagaagtgtgaggctgggctgccccagctgctcgtcctggccccatctgctgagagtgattctcagagcagccaggcttgaaggtcctgcagggtcgggtggaaggggccaggtgactctctgaggctccctcctttcctcctccttggtggcagcagcactgacatgaccatgtccctactgttctaaaggaaatcaactattctttctgaatatggaagctaacgtatcattcgggattcatgaagtaaaagagaaaacattatagatattacaaggaaaaatattttaaatacaggttattattacattttataaaggatacaaatttcatatgtacaggtttttatatgtagagctttttaaaagatttttgcttatgaaagcccatgctttaacagacacacacacacacacacacacagtggagagagagttctctttcatctgctggttctctcccccaaaggctacccaggctgaggctgggcctgccaaaagctgggcaacggaatttcttttcttttcttctttttaagatttattttattgatttgaaagacagagttacagagagatgtgcagacaaagatgtcttctatccgctggttcactgcccagatggctgcaaaagccaagctgtgccgatccgaagccaggagcttcttctggtctcacatgctggtgcagcggcccaaacatttgggccattttccactgctataccaggccataggggagagctggattggaagaggagcagctgggactagaaccggtgcccatatgggatgctggcgcttcaggccagggctttaaccctctgcgtcacagcaccgggcccgggagatggaatgtctttcaggtctcctacatgggtgccaaggctgaaacacatgttccagctgcctcctatggctgggaaagcagtagaagatggcccatgtggttggtcccctgcacccacgtgggagacctggaagaagctcctggctcctggcttcagattggcgcagttccagccattgtggccagttgcggagtgtaccagtggatggaatatctttccctgtctctctctctctctctctgtgtctcaatctctgcctctccttcactctctgtgtaactctgactttcaaataaacaaatctttaaaaaaaattagcagagaagaaggtatgtattaactttcctttgtgggcttgagaacaatgagcccctatcacagcctcctaatggagtgcagctggagtgctcacaacagtcaagtcacacagagattctgtgcagccgctgtgctgggctttgcacggagagagcggtgtgagaagaggaaaagagctcagattaggagctgaagagcctggtttagtctcagcgctgctgagctgggagaagacccggtgctctggcctcctgttccctgagtctaggtgggagggacagagggcttcccaggttccttttgctgtcaggctctgtgttatgggggtggaaaaggtggaggagcagtgttgctgggagctgcagagcatccgagtggacagcagcgggcggggaccccgtggttcagaagaaagcccatcttcagtttcccaccaggtgcccactgtctttttttcccatccactaacagcaaatgttcacaacaggaaagctgggtgtcgtttactgattgtgacgaacgcatggatgtgagctgtcagctgggtgtgcagtggaaaggcactgtgtgtactgcttcacaattttttgatttgtaaatttaaagctattctgaaatggaaagtttctttacacaacaacacaacaacaacaacaataacaacaaactgagtatcacagcaaactgtgaaaaagaaaaaaacgttcccctggcgtgactttagtgttcatattgtcctgctgcttgtctgcaggaggctgacagacatctgcaaataagaaatcagccctggaaagggttttttaaaattgtgtatgtatttatttttatttgagtgggagagagagagggagagagatcttctgtccattggtttactcccccaaaggccaggctgaagccagtagcccaggactccgcccaggcctcccacgtagatggcagggacccaggccctgagtcctcactctcagggtgtgcatgagcaggaagctggcatcaggagcagactgggattagaccaggcattcagtgtgcgatgggagcaacccaagggccaggctgatgccggggtcagggactccatctgggcctatgtgggtggcagcagccaaagtacttgggccaccatctgccacttcccaggtgcatgagcaggaagatgcatcagaagcggagctgagactcaatcccaggcactcaaatgtgggctgtgggtgttccaagtggcagctgaagacactgccacagcatccactctgcctaatttctactatttatttccttccagtgacttttggtttggtgtattttaatttttctatgtcttgagatcactgtcacatttttaatttgatgtctttcttggtttttgtggatgtgagtacatattgcattaaacttccctggctccttgttttggcctggcacagctctggccattgtgggccctctggggagtgatctctccctctctgtgcctctgtctctccctctctgtaactctacatttcaaataaagaaattagtaaatcctttctgtaaaaaaataaaaaaggcctgaggctgcaatctccctgcagccacttgctcaggggatactcccccctccctcagcttggagaatcccagttcaagtttatccagctcctcagaccaggagtcaaacacagagcagtctggatgggctgcctcacaagcgactgcccgcttccaggattcacacgtttcttatggagtgggtgcgtgcactagtcaggtttgaatagcacggatttcagtgttgtcagttgagaatccagcaggatactggtaatagttaaggttttggtcatggattacatgactacactgcgttcccacacttgatgttacctatgtgcacaagcagtgaggtcgtgcatcattttcccacgatggccctgggctgtgaagcttcctccccttagggcgcagcagtcccctgggtcacagagtttgctgagaagctgtgctccttgggggactgactgaaagcaagagtgtatcagattacattagtcccaaaagtccaggaggggtagagggatgaacatttaactgtttaggcctgtggatttttctcattaagataatcatcatgtctagtaacacaagatcattagactttttaactttaggactttttttttttttttttttttttggacaggcagagtggacagtgagagagagacagattgaaaggtcctccttttgccattggtcaccctccaatggccaccgcggccggcgcgctgtggccagcgcatcgcgctgatccgaaggcaggagccaggtgcttctcctggtctcccatggggtgcagggcccaagtacttgggccatcctccactgcaccccctggccacagcagagagctggcttggaagaggggcaaccaggacagaatccggagccccaaccgggactagaacccagtgtgccggcgctgctaggcggaggattagcctaatgagccacggcgccggccaggacatttttatcggtagcattttatatgataaaacttataatttagtaccacttcacatcttgacagtacttctatctagtataatccgaatagcctgattagttggtgtctctacaagatgagagacatatatcctttgatttttctagttggttgggcccaaactggaaaattaaagtccactttaatggaaatttcagagtccaaattctttggaactttgatttttggttttttggaatgcctgtcaaggatgccaagaaagcttaaagtatccgcttgaaataagatccttcaccatcaggacataatatagaccaaatttgatcattgttagaagatgattgttcaaatgatttagaataagcatttatttaaataaaccaaagctcttaataaaaaactcagctgtttctaaacttttagaatttaacagcggcatcaagagaacataatagattacttttgatggaacaaggacataagcctcagccattctccctcactgcccaaaggagataaactttgagatgtattccttgcccttgaatctcaattgggtctgacaccctattgccttcataccccaccctgcattcttttccaggttcaaaaggcacacccgccccccccccccccccccccagttcctggaattcccttccctgctgcctcctacctccaccccagccctagccctcctggcctggcatctgggagtcaaggccttctgccacaggctccatcttgtacacacagaggtcacccacctctgcggatttattttctctgaataaattcggtctgtctgtaaattcgtgcattgcctcttctctaatatgcagcggaggattaaccaagtgagtcatgtcactggcccctgaaacccatctttaaaacagatgtctcagacaaaaaaaaaatagtgtaaggatttcatgaaacctcccgagatgttgaatgtggaggcagctccagactctgactggggtcaccactccttgagctcttttctaggtgacagctccagagaagcagcctgcgggtgttcctaacgcttcctgcacttacctctaagtctagagtaagccccagtgaaacatggaaatgcatatagaactgttagctcttccatggttttatcataccaagatacatgagtttaacttactttaatgcaggcaaagcatccaatttctgtccatttaccttgttaaaataacattcctctcatacatactgatttcttgacccaaatggaaatattaaccttaggtcaagatgggagagagatgactacaatgaatgtctttactaaaataccacacacacgcacacaaatgcagagagagagagagagagagagagagagagagagagttttcttccatctgctgttacactctacaaatggctgcaatggccaggtctcccatatgggtaccagggcccaatcacttggtacatcttcagctaattttccaggccattagtatggagctggattcgaagccagcactccaactggtgcccatgtgcgatgttggcattgcaggggtggccttattcacaacaccacaatgctggcccgtcatgtatatgttttaaaagcatcataatagttcaccatgtgctccatcctgcctcactcacagtgctcttctttttttaattttgatttattttaaaaggatttatttgtttatttgaaattcagagttacacagagaggagaggcagagagagagaggtcttctatctgatgattcactccccagttggccacaatggctggagctgtgccaatccaaagccaggagccaggagcttcctccatttctcccacctgggtgcagggccccaaggatttgggccatcttctactgctttcgcaggccatagcagggaggctggaacagaagtggagcagccggtactcaaaccatcacccacatgggatgccagcacatcaggccagggcattaacccgctgcgccacagcgcaggcccctattttaacttttttttttttattccaagaaataatttattgagcatcagagaacatagtttctcaacctcaaaaatatatatgaatcaggtttttttcaaaagcatccaattagcatgacgttgttattgctatgggtaattgtttctttcactgtctttttttttttaacttttatttaatgaatatgaatttccaaagtacgacttatggattacaatgggcttccccccaataccgtccctcccacccacaaccctcccctttcccactccctctccccttccattcacatcaagattcattttcaattatcttaatatacagaagatcagcttagtatacattaagtaaggatttaacagtttgctcccacacagaaacataaagtgaaaaataatagatgatttttttaaatgatgatgaaatcagagcagacctattgtcatgtttaatcccagtgagagtcaagttgggaattgataatttctttttttttttttttttacagaagatcagtttagtatgcattaagtaaagatttcaacagtttgcacccccatagaaacacagagtggaatatattgtttgagtactcgttatagcattaaatctcaatgtacagcacattaaggaccgagatcctacatggggagtaagtgcacagtgactcctgttgttgactttaccaattgacactcctgtctatggcatcagtaatctccctatgctccagtcatgagtttccaaggctatggaagccctctgagttcttcgactcttatcttgtttagacaaggtcatagtcaaagtggaggttctctcctcccttcagagaaagatacctccttctttgaagacctgttctttccactgggatctcactcacagagatctttttgccagagtgtcttggctttccatgcctgcaatactctcatgggattttcagccagatccgaatgcctttagggctgattctgaggccagagtgctatttaggacatctgccattctatgagtctgctgagtatctcacttcacatgttggatcactctcccctttatttattctatcggttagtgttagcaggtactagacttgtttatgtgatccctttgactcttagtcctttcattatgatcaattgtgaactgaaattgatcacttggaatagtgagatggcattggtacatgccaccttgatgggattgaattggaaacccctggtatgtttctaactctaccatttggggcaagtcagcttgagcatgtcccaaattatacatctcttccctctcttattcccactcttacgtttaacagggatcacatttcagttaattttcaacacttaagaataactgtgtgataattacagaactaaaccagtcatattaagtagaacagacaaaaaaaaactactaagagggataatgtattaagttgttcattaacagtcagggctatgctgatcaagtcaccgtttctcatagtgtccatttaacttcaggaggtttcctttttggttttcagtcagttgtcaccgatcagggagaacatatggtatttgtccctttgggattggcttacttcactcagcatgatgtgttccagattcctccattttgttgcaaatgactggatttcgttgtttcttactgcggtatagtattctagagaatacatatcccacaatttctttatccagtctaccgttgatgggcatttaggttgtttccaggtcttggctattgtgaattgtgctgcaataaacattagggtgcagaccgcttttttgtttgccaatttaaactcctttgggtaaattccaaggagtgggatggctgggttgaatggtagggttatattcaggtttctgaggaatctccagactgacttccatagtggcttgaccagtttgcattcccaccaacagtgggttggtgtcccttttcccccacatcctctccagcatctgttgttggtagatttctgtatgtgagccattctaaccggggtgaggtgaaacctcattgtggttttgatttgcatttccctgattgctagcgaccttgaacattttttcatgtgcctgttggccatttggatttcctcttttgaaaaatgtctattgaggtccttggcccatctcttaagtgggttgttggttttgtttttgtggagtttcttgatctctttgtagattctggttattaaccctttatctgttgcatagtttgcaaatatttcttcccattctgtcggttgtctcttcactctcctgactgtttcttttgcagtacagaaacttctcaatttgatgcaatcccaatagttgattttggctttgactgcctgtgcctcccgggtcttttccagaaattctttgcctgtgccaatatcttcaagggtttctccaatgttctctaataacttaatggtgtcaggacgtagatttaggtctttaatccacgttgagtggatttttgtgtaaggtgtaagttaggggtcttgcttcatgcttctgcacgtggaaatccagttttcccagcaccatttattgaatagactgtccttgctccaggaattggttttagatccttgatcaaatataagttggctgtagatgtttggattgatttctggtgtttcaattctgttccattggtctatccatctgtttctgtaccagtaccatgctgttttgattacaactgccctgtagtatgtcctgaaatctggtattgtgatgcctccggctttgtttttgttgtacaagattgctttagctattcgaggtctcttgtgcctccatatgaatttcagcatcattttttctagatctgagaagaatgactttggtatcttgattgggattgcattgaatctataaattgcttttgggagaatggacattttgatgatgttgattcttccaatccatgagcatggaagatttttccattttttggtatcctcttctatttctttctttaagtttttgtaattctcatcgtagagatctttaacgtccttggttaagtttattccaagatatttgattgtttttgtagctattgtgaatgggattgatcttagcagttctttctcagtcatggcattgcttgtgtatacaaaggctgttgatttttgttcattgattttatatcctgccactttgccaaactcctctatgagtcccaatagtctcttagtagagttctttggatcctctaagtaaaggatcatatcgtctgcaaagagggatagtttgacttcttccttctcaatttgtattcctttgatttctttttcttgtctgatggctctggctaaaacttccagaactatgttaaatagcagtggtgagagtgggcatccctgccaggtgccagatttcagtggaaatgcttccaacttttccccattcaataggggttttttataaattgctttgattatattgaggaatgttccttctatacccaatttgcttagagttttcatcatgaaagggtgttgaattttatcaaatgctttctctgcatcaattgagataatcatatggtttttcttttgcagtctgttaatgtggtgaatcacattgactgatttgcgaatgttgaaccatccctgcataccagggatgaatcccacttggtctgggtggatgattttcctgatgtgttgttgtactctattggccagaattttattgaggatttttgcgtctatgttcatcagggatattggtctgtaattttctttcagtgctgcatctttctctggcttagggattaaggtgatgttggcttcataaaaagaatttgggaggattccctctttttcgattgttctgaatagtttgagaagaaatgggattagttcttctttaaatgtctggtagaattcagcagtgaatccatctggtcctgggcttttctttgttgggagggcctttattactgtttcaatttctgtctcagttatgggtctgtttaggttttctatgtcttcatggttcaattttggtagattgcatgtgtccaggaatctatccatttctgatagattttcctgtttgctggcatacaggtccttgtagtaatttctgatgattctttttatttctgtggtgtctgttgttacgtttcctttttcatctctgattttaatgatttgggtcttttctcttctttttttagttagttgggccaatggggtgtcaattttgtttattttttcaaaaaaccagcttctcgcttggctgattttttgtagtgttttttttttgggttcaatcctgttaatttcttctctggttttaattatttctcttctcctactagatttgggtttggtttgctgcagtttttctaggtccttgagatgcgctgaaagctcatttatttggtacctttccaatttcttgatataggcacctattgctataaatttgcctctcaatactgcttttgctgtatcccataagttttgatatgttgtgttgttgtcttcatttacttctaaaaagtttttgatttctcttttgatttcttgaatgacccagtgttcattcaggagcatgttgttcagtctccatgtgtttgcatactttctggggtttcctgagttgctaatttccagcttcattccgctgtggtctgagaagctgcatggtatgattctaattcttttgaatttgctgggacttgctttatggcctagtatgtgatcaatcctagagaaggttccatgcactgctgagaagaatgtgaagtctgtagatgtagggctgaaagttctgtagatatctgttagatccatttgggcaatagtgtcaattaaatctgctgtttccttgttgatcttctgtccggatgatctgtctatttctgagagtggagtattgaagtcacccagtactattgtattggaatctaaatctccctttaagtcccttaacatatcttttaaatagaccggtgccctgtaattaggtgcatatacatttataatagttacatcttcgtgttgaattgaacccttaatcattatatagtgtccctctttgtctctcttaacagtttttgtattaaagtttattttgtctgatattaatatggctacacctgcttttttttggtttctgttagcatggaatatctttttccaacctttcactttcagtctgcatgcctctttgttagagagatgtgtttcttgtaggcaacaaatagttggttgtgttctttgagccggtcagccaaacggtgtcttttaactggagaattcagaccattaatgttcaatgtgactattgatacgtagtgactttgccctgccattttcccggagatattttctagtatatgctttgagcttcccatgctcttttactggtaggtgttcttcctttcccttctttcatattgatggccgtgtttctgtgtttctgagtgtagcacatctttaagtatcttttgcagggccggacgagtggccacaaagtctttcaatttctgtttgctatgaaaggtctttatttcaccttcattcacaaatgagagcttggcaggatataatattctgggctggcaatttttctttcttagcacctgtgctatgtctcgccattccctcctagcctgtagtgtttctgatgagaagtctgctgtgagtctgattggagatcctctgagagtaatctgacgtttctctcttgcacattttaggatcttttctttatgtttcactgtggtaagtttaattaccacgtgtcgtggtgaggatctcttttggtcatgtttattgggggttctatgagcttcctgtactaggatgtctctgtccttctccaaacctggaaagttctctgctagtatctcactaaaaaggccttctaatcctttctctctctccatggcttcaggaactcctagaactcgaatgttggtttttttaatagtatgctgtagattcccaacaatattttttagatttctaatttcctcttcttttctttggtttgactgtatgttttcctgtgctctatcttctaagtccgatattctctcttctgcttcacccattctgtttttaaggctttctaatgtgtttgtcatttgatctattgagctcttcatttcattttgatttctcttcactatcacactttcctgttctactagtttctgagtttcattttgattcttccttaaaatttcattttcacgagagagattttcaatcctgtccaataaggatttctgtagttcaaggatttgcttttgaaaacctctaaatgttcttatcataaattttttgaaatccgtatcttgcatttcttctatctcatcatctcatcatcttcataatcttggtttgctgtgttttgtttatttggaggcatcatagtgtcatcgttgatcttgttccctcgatttctgtgtttgttacttggcatagttaattcttctttcgtcactgtgcgtttttttttttttttatgctatgtccgtgttaagtggactgcctgctgttgggggtgccttggaggcttgagatgggtgcggcctgagagctctgcttggttcttcctggttaagggtgtgcaaaggtgacaccctcaggttatgcgtggtaaatctctctctatttatttatttatttatttatttattttatttattcagggggtaagtaataccacatggcaaggctgtgcagaattgatggtatttagcttccagtctctggcttctacccagagtctgtttaggctcctctggactcccactgagttgcctaggctactgaattgtagtgactcagttccttagctctcagctgttgatatgtaaatccagagaggaggcctgttctttgtctcttgtgaattcttcaagccttgcagccttgcaaaagagagacccccaagctttttttttttttccttctttccggtagtgagtttgctgcactttccagcccccctctagattctgacccccgtttccccgccaatgtctcgggttattgagctcacctccccttccagcgccgatgtgtggactcggagccctgggcgtcccaactctccccgctgttgtctgtgtgacatgcactctccttcccgcactggcgtgcagaccctgcagcttccgcggcacccgcttccgcgcggtgggcgaccttgttctcccagtaggtcctccgattcacagccactcgatccagaagagattcctctgcaatattttcctggttcttttttctgatgctaccgtaactacccttttattaaactaaattttcccggactatcggtgcgcgccctcactattctgccatcttggctccgctattttaacttttgaaagacatactttcaatgtactttagcactagctcagccctccatatatacaaaattcaacatgtagtaagcagaaaaccactgttcctcatcctaaagacaaggctatgcttctcaattcccccaatcccactgtcactaccagacctgaggtgcacttccgccccctgggggtcataggtggaatcatgtcagctttcaatccctgatagagcagttcttcatttaatctgaaatcaaatagaaaattctcatggaattgaaccaatagtaacttcattgcacacaatggcacacaactaatggattcacatctcttgtagatgtagactaagtggaaacatcgaacagagcccttcatctcacagatcttccatggtagtgggcagggctgatgatactcaaaccaataacgttctacctctgctcctgatattggaatttgaccttccaaaaatataatttggggtgccatacgatatcaccatatgcttattaataagttccccattaataagcccatgtgggttcttgcctaatattcagagaattctaaatactggcataggtgaacaagttagcatggtacattttaagcatttattcagtgagaaagatgcataggagagtgagggccccgtctaaagcagagaggtaaatgtgggttcatactaagtaccaggaaccagccacgtggaggaacatctaggccaggaagtgtggggcaggtggcccaaaggcaacacaccatggaggcacagggctgcagccagccccctactggcaagaagccagtgagagaagggagggaaaaaggccagacacaccatgtcccaggcttttaatccacttccaaggggagtggttaattcacctgattgaccggtgcccacccaggtgtggccagcagtggagcagtggggaatcaaagcagtctctgatgtaggctgctggctttgcaagtggcagctaatccactgtgccacgatgccagccttccctcctctctggattttcttaagacaaacgtgaacgtttctgaagaggggagagagggaagttaattttcttgatgttcctgagacctatgatgaagccttgaactttcacttcttttttcgttatgcaatctgatcagaactcaggctgcagaagggagagcgcacctgtgtgatctctcctctaagcacctgcgttctccttctgagtcctggtctctctctggcagccgcttgttctgaggatgtttattctaagtcagtacagaggtgagtgtggacagaagtctcgaatctcagagaccatctccctggtgcagcggtctgccgtgaggggaccacgtgagggcatcagaacacaagtaaagaaatggccttaggcataaattagtttactatctattttaaagaaaaggaactttctcctacagatcccagataaccatgaatttattacaccatcttgtccgataaactcacaattttggcaaatgcccctcagaaactttgggaggtgacatctcctggtagaaacatgcgcacttcaggtaaacttgtgcagccctggtctgagctggggcagctggagacacagcccctggactgagttctgagctgccctgggcccttcagctgggcgcagccctgccccgcccctgcggatttgcatgtccccagagcaccgcccacttctctgggcatttaggagcaggctgctcccaccccatgcaggaggcagtgccaggcaggacccagcatggacatgagggcccccactcagctgctggggctcctactgctctggctcccaggtaaggaaggccagcagcaggaatggcctcgggcagtgtgaccagggctgcctgtctttgcaggagcgtcctcttagaacgtgaggatgagtgtggtctctgtgtttctgtttccctcctcagg

SEQ ID NO: 114 - DNA, 2508 bp, Oryctolagus cuniculus
ccacagtgatacaagccctaacaaaaacctcccaggaaagcagaagtgtgaggctgggctgccccagctgctcctcctgggccccatctgctgagagtgattctcagagcagccaggcttgaaggtcctgcaggttttgttggaaggggccagggtgactcctctgaggccccctcctttcctcctccttggcggcagcagtacacactttgggtaaccttccgtgtctgctgagatgcagtcagataggagaattctctgatccctcaccacctgcacacaggggcagtgtccccaggtgtccacatcagacccaggttgcacaggtctcctacagagaatgtctctctggggtctcagcagagagaggaccagtgtgtgtagaggtccacgctctcctcacggctcagcccagctttgctgctgctgctccacctgtgacaggggctgcagggcttgcacagcccagaacctggagaagctgagcagctcctcagtgtggttctggtggacgtcactgaggccagggcggcttctgctttctcttatttcctaatggcctttgtaacataaaagagcaataaatagaaaacatagtgagggctatgatttataaaactggctgtgcttggatcctgccacacactgggagtcctacatggagttttgtgctctggactgtggcctgacccagcctcagctgacaggctcatccgggaaactaccagcacgtggaggattttctctctctctctttctctctctcactttgtctttcaccaatgctcagtctttcaagtaaataaataaataaatatttttaaaaatgggaaatattacatttaataaaataaatggggggcacatgtgcaatcgtgtcagttttcaatctgatggagtagttcttgattcaatgcaaaatcaagtagaacattctcatccaattgcactaatagcagcttcactgttggcacataaaggcacacaaagaatagtagcacaaattcttaggcctgaaataattggaagaagtcgaacagagccctttatgtcatagatctttcattttagtgggccgggcagatgagaaacaaaccaatgacgttccaactgtgctcccactgtgtccatgtgatgtgcctcccatggagcagggccagtgctcaggacaatggggctgtgggtgtgcaggtgcatgtgtgcctccttctgtctccacctagacagggcagaggcagaggcagaggagagggaatgtatcgggcaactccacatctgtgtttcctgaaaaataaactcattgtactctcggtgatggtcgggtagacaaactgtcctgacaaaagattttaagatttctcatgtccctgtagcataaagtcagtcagcacacaggtcagagggaataatcagtgcccagacactggagataaaaaaaatggagcccagttttagtgcgcattagcagggaatgtgatcagaagtggagcagtgggcttcaatccagtgtctgatgtaggctgctggctttgcaagtggcaacttaatccatgtaccatgatgccagtctaccctcctctctagattttcttagagataaagtgaaggtttcaggagagaggagagaaggaagttatttttcttgatgtcttcagacctatggtgaggccttgaactttcacttttctttcctcctgcatccttgactcagaactctggctgcaggtgggagagcacacatgtgtgatctctcatctaagcacctgtgttatccttctgagtcctggtctctggcagccgcttgttctgaggatgtttattctgagtcagtacagaggtaagtgtgggtagaagtctcgtctctcagagacaatctccctggtgcagcggtctccatgaggggacaagatgagggatcaaaggacaaacaggtgaaagacatggacctcagctttaaggtgtaactaagtattccctagaaaagcatttctactaaagaattccaccataagcatgaacaaattacaccttcttgtcctccagttcaattatagggttggcaaatgtccctcagggaatttgggaggtgatgtctcctggtggaagcatgcgcactgcaggtaaacttgtgcagccctggtctgagctggggcagctggagacacagcccctggactgagttctgaactgccctgggcccttcagctgggcacagccctgccccgcccctgctcatttgcatgtccccagagcaccgcccacctctctgggcatttaggagcaggctgctcccgccccatgcaggaggcagtgccaggcaggacccagcatggacacgcgggcccccactcagctgctggggctcctgctgctctggctcccaggtaaggaaggccagcagcaggaacggccttgggcagtgtgtccagggctacctgtctttgcaggagcgtcctcttagaacgtgaggatgagtgtggtctctgtgtttctctttccctcctcagg

SEQ ID NO: 115 - DNA, 3476 bp, Oryctolagus cuniculus
cctcggtattacaagccctaacggaaacccccaggaaagcagaagtgtgaggctggactgccccagctgcttctcctgggcccatctgctgagagtgactctcagagcagccaggcttgaaggtcctgcagggtcgggtggaaggggccaggtgactctttgaggctccctcatttcttccttggaagcagcaccacagacttgaccatgaccctactattctaaagcaaatcaactatattttctgagtagtcaaagctacagcatattttgattcatagagcaaaagggaaaactttacagatattccaagcaaaacgagtttaatacaagtgattatataaattctataaagggtatcattttcatagctatggtttttttttaaaaagatttatttcctttctgaaagtctctgctacacacaccacacacacattgagagagagagagagagaaagagagaaagagaatgagattttgagggatagagagtgatcttccatccgctggttcactccccaaatggttgcaatggatgagcagtgcctggcagagctaggagatagaactcctttcattctcccacatggtgcccgagctcaaacacgtgggccagctccaggtgctttcccagggcaagcagggagctggattggaagatgagaagcctggactcccaccggggcccatgtgggatgctggtactgcatgaggtggctttacccactgcatgaggctggcccatcccatccacagtgatgagggcataatgccactgcccaccatgtccttccatgcttcctcactccccctcactcctcttttgtttttcttttaagttttacacggacatactttcactctataatcaccagcttaactctccactaaacaaataattcaacaaggtttagcagaaacaacactgttctcaagagtttacccaaggctgggagtcgcatcctcccaatgcctgttactacaagaccataggtgtgctggcgtccccatggggtcacaggtggaactgcatcagctttcaatccctgatagagcagtcttcattcaattcaaaatcaaatagcaaattctcatcgaatcgaacaaatctcctaggcatagaacaattgttatttatctcatagatctttttttagtgatcagggcaaataagcaaacatatgttttacacctgctcccatgtgcttcaagtgagatcctccctggacactgccattgctaggggcacgtgggcagtgggtgtccaggcctacctagtgcatcttcctgtctgggacacaggcagagggagaggcagagggaacgaactgggcagttccatactgtgtttcttgaaaagatacactaattgtagtctcagtaatcgtcagatggccaatagttcttcgattgagggaaaagcttcttaaatttctcaaattggtgaggcatgaaaccagccaacacagaggtcagtggaagaatcagtgcccagacactggatgtgaaaataatggagcccacggcactgcggcacagcaggttaaagccatggcctgaagctctggcatcccatagggtggcggttcaagtctcagctgctcctcttttgatgcagttctgctatggcctaggatagcaatagaagatggcccacgtctctgggcccctgcaccaagtgtgagacccagaaaatctcccggcttctggtttcggatccacgcagcaccggcttttgccgccatttagggagtgaaccagcagatggaagacctctctctctgtctctacctctctctgtaactctttcaaataaatgaaataaatcttaaaaaaaaaaagagcccagctttagcagggtgttttgtactgtggtgaatacttatttctaataaatataatttagataattttcataaatgttaacattttccatgtttcaaaatatttatttattcacttgtaagtctgagcattggagagaggcaaagatgggggttgggtctgtaagtggtctctccacaaatggctgtaacagtgagttcctggccaagcagaccccagagccagaactgcccctggtctcccctgtggggcaggaatccacgaacttagggcatttcctgctgcctcccagggtgtgcattagcaggaaatgggatcagaagtggagcagtaggattcaaaccagtctctgatgtaggctgctggcattgcaagtggcagccttacccactgtgtcatgatgctggccttccctcctctccgatttcttttttttttattgaaagacaaatttacagtgagaggcagagaaagaaagaggtctcccatcctctggttcactctccaagcggttgcaatccttggagctgggctgatccaaagccaggagccaggagcttttctggatctcccaatgggtgtagtgcccaaggtcttgggccatcttctacctctatcccaggccatagaggagcgctggatcagaagaggagcagatgggactagaaccagtgccgatatggaaagccagtgcgtcaggccagtgcattaacactctgtgccagagcacggtctccctctctggatttcttaagatttcttaagatttcttagacctatggaaattccttgaaacttgcacttctgttttcctcctgtatccttgactcagaactctggctgcagatgggagagcgcacatgtgtgatctctcatctaagcacttgcgttctccttctgagtcctggtctctctggagccgcttgttctgaggatgttaattctgatcagtttcagaggtgagtgtggacaaagtctcgtttcttagagaccatctccctggtgcagcggtctgccataagaggacaatgtgaggtcatcacaggacaaacaggtagacatggccctcagctttaaggtgtaactaagtattccctaaaaatggactttctcctacagaatccgaacataaccatgaatacattacaccagcaggtcgttcagttaaccaaaagtttttgcaattgtccctcagtgactttgggaggtggcgtctcctggtagaagcatgcgcactgcaggtaaacttgtgcagccctggtctgagctggggcagtggagacacagcccctgggctgagttctgagctgccctgggcccttcagctgggcacagccctgccccgcccctgctcatttgcatgtccccagagcaccgcccacttctctgggcatttaggagcaggctgctcccgccccatgcaggaggcagtgccaggcaggacccagcatggacacgagggcccccactcagctgctggggctcctgctgctctggctcccaggtaaggaaggccagcagcaggaacggcctcgggcagtgtggccagggctgcctgtttatgcaggagcgtcctcttagaacgtgaggatgagtgtggtctctgtgtttctctttccctcctcagg

SEQ ID NO: 116 - DNA, 7821 bp, Oryctolagus cuniculus
ccacagtgatacaagccctaagaaaaaccagcaggaaagcagaagtgtgaggctgggctgccccagctgctcctcctgggccccatctgctgagagtgattctcagagcagccaggcttgaaggtcctgcagggtcgggtggaaggggccagggtgactcctctgaggctccctcctttcctcctccttggtggcagcagcacatacatgaccatgtccctactgttctaaaggaaatcaactattctttctgaatatggaagctagagcatcattcgggattcatggagtaaaagagaaagcattatagatattacaaggaaaatattttaaatacaggtgattattacattttataaaggatacaaatttcatatgtacagttttttatatgtagagctttttaaaagacttttgcttatgaaagtccatgccttaacagacacacacacacacacacacacacacaaagtggagagagagttctctttcatctgctggttctctcctccaatggctcaccggctgaggctgggcctgccaattggcgacggaatttcttttcttttcttctttttaagatttattttattgatttgaaagacagagttacagagagatgtgcagagaaagatgtcttctatccgctggttcactgcccagatggctgcaaaagccaagctgtgctgatccgaagccaggagcttcttctggtctcacatgctggtgcagcggcccaaacatttgggccattttccactgctataccaagccataggggagagctggattggaagaggagcagctgggactagaaccggtgcccatatgggatgctggcacttcaggccagggctttaaccctctgcgccacagcaccaggcccgggagatggaatgtctttcaggtctcctatgtgggtgctaaggctgaaacacatgttccagctgcctgctatggcctgggaaagcagtagaagatggcccatgtggttggtcccctgcacccacatggagaaccggaagaagctcctggctcctggcttcagattggcgcagttccagccattgtggccaatacctttccctctctctctctgtgtgtgtgtgtgtctcaatctctgcctctccttcactctctgtgtaactctgactttcaaataaacaaatctttaaaaaaaagtagcagacaagaaggtgtttatttactttcctttgtgggcttgagaacaatgagcccctatcacagcctcctaatggagtgcagctggagtgctcacaacagtcaagtcacacagagattctgtgcagccgctgtgctgggctttgcacggagagagcggtgtgagaagaggaaaagagctcagattaggagctgaagagcctggtttagtctcagtgctgctgagcgggagaagacccggtgctctggcctcctgttccctgagtctaggtgggagggacagagggcttcccaggttccttttgctgtcaggctctttgttatgggggtggaaaaggtggaggagcagtgttgctgggagctgcagagcatccgagtggacagcagcgggcggggaccccgtggttcagaagaagcccatcttcagtttcccaccaggtgcccactggcttttttcccatccactaacagcaaatgttcacaacaggaaagctgggcgtcctttaccgattgtgatgaacgcatcgatgtgagctgtcagctgggtgtgcagtggaaagccaataaaacaaagttcttaataaattttcccatggagacacacaatatgtatacacatataacataagagatagaacaataaaatcatttcaataataggtttctttttttgacaggcagagtggacagtgagagagagagagacagagagaaaggtcttccttttccgtgggttcaccccccaatggcagctgtggccagcgcaccgggctgacccaaagccaggagccaggtacttctcctggtctcccatggggttcagggcccaaggacttgggccatcctccactgcccttctgggctacagcagagagctggactggaagaggggcaaccaggacagaatttggtgccccgaccgggactagaacctggtctgccagtgccgcaggtggggattagcctattgcgtacgatgccagcctcaataatagattttaaactcttcaactgttttttagtttaccaattgattcgatttactttctgctcttagtttcctgaattaaccctgctttcttccaggtggaacctgtagtgcattattggcttcatctgtttacagagccatcccaaagtactgagtacagcagaagtggctgggaaaagtctacgggaacctatacaaaactgtgaatgacaaaaggctttaaatagccatgcttaaaattagaaaccatgaaccaacaaaaggcagttgtgtcctttacacagtagttttgaaagcacctgtagggttttacagaatatttaaccttcgggtttttggaatgcctgtcaaggatgccaagaaggcttaaagtatctggttgaaataagatccttcaccatcaggacataatatagaccaaatctgatcattgttaaaaggcaatgattcaaatattttagaataagcatatatttaaataacccacagctcttaaaaaaaaacttagctgttttctaagcaattagaatttaacagaggcattgagagaacataatagattacttttgatggaacaaggacataagcctcagccattctccctcactgcccaaaggagataaactttggaatatagtcctgtgggaaatcccacaggaatctcaaaaagagtcacggagcaccacttacctgaaaaggagatgaactgtggaaacacattaaaacattgagttaagaagttaccactagccacaaaataaaagtaaagtggagttacaagtcaggagctgaggcaatgcctaacggctgttcgggagacactcctaatcatgccaagcagacatctctggtcagtcaggtaacagtgtgctgtggacaataccctcctacccacgctgactggaccgttcaaccatacgtaaggtgggagcagcattgattggacaagttgggggatggcaagctggaggactgccgaaaatgaggataaaaagggagcccttgcaccactctccatcctctcggggatcatggcccggtgtgtgtgaacctctggatctccacacatccagagctgaagtggcagcctgctactctgcacagaacaggtagcagcacaagccgacctgcagatctgtccctgagctgctaccccactgtctgtctcagtgtgtgtgtgtgtgtgtgtgtgcgtggcccagtgcgagtgaacctctggatctcctcacatgtggagtcaaagagccagcccactagcttttgctacgcagcacaaggtgacaactggatcaagaggccatctggagctgcggcgttgctgcccagctgctgtctgaccagtggagctgccgtctcacgacctcacctggagtccttatcagcctgctgctagagttgaccgcagcgccacagagctggaccaggcctctcagcaggggacctctccaacttctcgcctgccgtccgcctggaaccttgagcctactgcccagagtgataaccttgccacgacttccctcctgtaagtgactggtccgagttccatccctgctgggacactgaactctggacactgggcactccccgcaggagaaacacattcgtgacagtgatgcgagcctagatacgtagcaaaccaatgttatgtactgaatcttttgctgtgtttgtagtgttcattgtgatagtacttaagattattttaatggtgtttgttttgacttgtggtataatattgattgcctggcagacaagtgatattgttaagattgggtagatgtagttaagtagttaagtgattaagtcaggtagttaagtggttaagttatgtagttaagtagttaaccatttaagtcaccttaaatagtagtgttaagtttagtgataagtgtattaaagaggatagattgataagtatattggtgctgataagtgtattgacctcaatgagcatgctgatgagtagtatgatataaacccccctggtgtgttcccatgtgtgtgaataataaagttggaaaagacagtgttgtgtccgtgtgttcctttcttccccgtgactgataagtcgtacgatgcacttgctactgttgagctaggtgacagaaggcgctcgcgacaattccttgcccttgaaactcaattgggtctgacaccctattgccttcataccccactctgcattctttccaggttcccaagacccttcccccactccagttcctggaattcccctccctgctgcctcctacccccaccccagccctagccctcctggcctggcatctgggagttgaggccttctgccacaggctccatcttgtacacacagaggtcacccacctctgcggatttattttctctgaataaattcggtctgtctgtaaattcgtgcattgcctcttctctaatctgcaatggaggattaaccaagtgagtcatgtcactggccccttaaacccatctttaaaacagatgtctcagacaagaaaaaatagtgtaaggatttcatgaagactcctgagatgttgaatgtggaggcagctccagactctgactggggtcaccactccttgagctcttctctaggtgacagctccagagaagcagcctgcgggtattcctaacgcttcgtgcacttacctctaagtctagagtaagccccagtgagacatggaaatgcatatagaactgttagctcttccatggttttatcataccaagatacatgagtttaacttactttaatgcaggcaaagcatccaatttctgtccatttaacttgttaaactaacatcactctcctatacactgatttcttgacccaaatggaaatacttaaccgtaggtcaagatgggagagatgactacactgaaagtctttactaaaataccaataaatttctcagacaacaaaaaagacaatttcatgctttccaatctatatttttttaaaaaaggtttatttgcttatatgtaaatcaatgatacacacatacacacacatgcacacacacaaatgcagagagagagagagagcgagagagagagttttcttccatctgctgttgcactctacaaatggctgcaatggccaggtctcccatgtgggtgctggggcccaatcacttgggacatcttcagctgatgttccaggccattagtatggagctggatttgaagtggagcagccatgactccaaccggtggccatgtgggatgctggcattgcaggggtggctttatcaactgcaccacaatgctgccctgtcgtgtgtatgttttaagagcatcatgatagttcaccacatgccccgtccggcctcactcccaccctcagtgctcttcttatttaattttaatttaatttaattttaaaaggatttatttatttatttgaaatgcagagctacacagagagagtagaggcagagagagaggggtcttccatccgatgattcaaacccagttggccacaatggctggagctgtgccaatccaaggcaaggggccaggagcttcttccatttctcccacctgggtgcagggccccaaggatttgagcaatcttgtgctgctttcgcaggctatagcagggagctggaacagaagtggaacatccgagactcgaaccatcacccacatgggatgccggcactttagatcagggcgttaacctgctgcaccacagtgccagcccctatttaacttttgaaatgacatactttcaatgtactttagcactagctcaggccttcatatataaataattcaacatggagtaagcagaaaaccactgttcctcatcctaaagacaaggctgtgagtctcaatcccctcaatccctctgtcactaccagacctgaggtgcacttgcgccccctgggggtcacaggtggaatcgtgtcagctttggatccctgatagagcagttcttcatttaatctgaaatcaaatagaaaattctcatggaattgaaccaatagtaacttcattgcacacaatggcacacaactaacgaattcacatctcttgtagatgttgtagactaagtggaaacatcaaacagagcccttcatctcacagatcttccatggtagtgggcagggctgataatattcaaaccaataatgttctacctctgctcctgatattggtatttgacaccccaaaaacacaatttggggtaccatacaatatcaccatatgcttattaataagttccccatattaataagcctatgtaggttcttgtctaatattcagagaattccacatactggcataaatgaacaaggcagcatggtaccttttaagttttattcagtgagaaagatgtataggagagtgagggccccgtctaaaggtgagaggtaccaggaaccaggttccaagtaccaggaaccagccacgtggaggaacatctaggccaggaagcgtggggcaggtggcccaaaggcaacacgccatggaggcacagggctgcagccagccccctactggcaagaagccagggaaggaagggagggaaaaaggccagacacaccttgtctcaggttttcaatccacttccaagggggagtggttaattcacctgattgaccggtgcccacccaggtgtggccagcagtggagcagtggggaatcaaagcagtctctgatgtaggctgctggctttgcaagtggcagctaatccactgtgccacgatgccagccttccctcctctctggattttcttaagaaaaacgtgaacgtttctgaagaggggagagagggaagttaattttcttgatgttcctcagacctatgatgaagccttgaactttcacttcttttttcattatgcaacctgatcagaactcaggctgcagaaaggagagcacatgtgtgttctctcctctaagcacctgcgttcttctgagtcctggtctgtctctggcagctgcttgttctgaggatgtttattctgagtcagtacagaggtgagtgtggacagaagtctcatctctcagagaccatctccctggtgcagcggtctgccgtgaggggacaatgtgagggcatcagaacacaagtaaagaaatggccttaagcataaattagtttactacctattttaaagaaaaggcactttctcctacagatcccaaataaccatgaatttattacaccatcttgtccaataaactctcaattttgacaaatgtccctcagggaattttggatgtgacgtctcccggtagaaacatgcgcacttcaggtaaacttgtgcagccctggtcagagctggggcagctggagacacagcccctgggctgagttctgaactgccctgggcccttcagctgggcacagccctgccccgcccctgctcatttgcatgtcccagagcactgcccacctctctgggcatttaggagcaggctgctcccaccccatgcaggaggcagtgccaggcaggacccagcatggacacgagggcccccactcagctgctggggctcctgctgctctggctcccaggtaaggcaggccagcagcaggaacggcctctggcagtgtggccagggctgcccgtctctgcaggagcgtcctcttagaacgtgaggatgagtgtggtctctgtgtttctgtttcccttctcagg

SEQ ID NO: 117 - DNA, 15095 bp, Oryctolagus cuniculus
cacagtgttccaagccctaacaaaaacccccaggaaagcagaagtgtgaggctgggctgccccagctgctgctcctggcccccatctgctgagagtgattctcagagcagccaggctggaggtccctacaggttttgttggaaggggccaggctgactcctctgaggcttcctcctttccctctccttgttggcagccacagagacacagtcaggtccctactattttaaggagagcagttattctgtcaggtaggaagtcagatatgagcttgtgtgtgtgtgtgacaaaggcctaaagagaagacatctatgtccggcatgtgcatctcaaagtcatccctataatgtttcaggggcagcccggtgttcccatcctgccctgcccccttctactcgataacctgccaggtgggggttcccaccccttctgcctgaaaatcttccaggtgcagcccaatatctgaacttcaaaagccctacctgcccttcctctaatgggggaggtgccagctagacttcgccctgtctgataacttcagggagaaaactcagataggagtttttctatttacatccataaagtgttttgtttcaggaggagatgtgtgaagacaaagactcatctccttaaaaacccccggtctcaactggactgcgcgctcagttctctgcctctctgctgagccacccacctggcctggtcaggtgtactctctccactcaaccatgtaacctcgctcttcccccagtccgagtgactgagcaccctctctcaggttctgtctggagaggtgcccatgcattcttatggatgtcccttccctaataaaccttgctattttactttccactaatctctgtctcacagctgaattctttcttgcgtgaagacaagaaccctgccatttgccggtaacattttggagaccatgacaggactttaagaagacatcgaaagtcagtattccttccctcaagtgggactggtctgtggaagtgaccattgaatgtccggcaccccacagctctccgagaatggggagtccccctggccatggcttagctatggctgaaactccagagggattgtaaggaatgggagggaatttaggaagggcagttggccgagagcctggagaccccctgagctcattttggcttccggtggccggactgtgacccaaggacctggcttctcttttggagggaccctggtcatgctgcctactgttatgtgagcagggcttagcttcggttgaggctagtattggccctccaggtaaactcagacaactaggtagtgggcaatgttgagtgataggcgattttgaacacccactcagcccccagacatcagggcctttccctatgctctcctccagttgagatttgtgggggaaggtgagggcagtcgctcacctcttgtcctctgttgctttcccccttcctcctccaggtcttcctccccctctttttgttctcctcatctccattcctatacctctggccttgaggaagggagaggaaaaattccacaggtctctccacctaagaaagggaaaaagctgttactgcttagccctttccaacctggtaggttttccatctttgcgacttaggatagctctggtgcgtcttaaagtttttgtgcgctattactgttgctaagctttgattgcctgaggactgaatctggaaaggagataaaattagctatctgttttaattgactgagtgattgcagtagccctaattggatctggttttggttgaaatattcgagctgtgtgggttaagatctcaccttggtggccattttaattagactagatagttggaacttctttgttgtgttaaaaaggttttgctagcttatattgtgtctacccaagggtctggttccttatgtgctgttaatgggatgcagcttcagagctgacctcattcccccatgggttttgtgtcaggtctggcttgctctgtgtgttgaatcgtgtgatagtaggggcagtgggaagcgtgtgccctccctccttctggtgtctgaccagggcctggttggcaccaggacaggaagctggttacctctccctgctgcacttctgtctttactctggccctcccctgttccctctaggcataggtctggactgggagccatctgatagactttgctattgggccatacccttcaaagtagaaagagcactttagtttagtttagtccaagcagatttgcaggctaggattctgttgtttaagatgaggggctgactggctttgccaaattaacattaaaatagtcagggcccatcaggccaagtctgattaagggataatactgagaacaggactccaaaagggagagatttagagatgttttggggcagttatgcagcaggtaccagattactgggtttcaggaaccccaagagtgtttgcaggttacacggtaatactagttaagtctggcaacccaggcccatcccataacccactggctacatggggagccaaggaataatttggaggtgggcagggacgcctgctccctccctagtgtggcagaaacccctgccatgacttttcctctagtctctttcagatgggaaaccaggtctcattaccatcacgtgactcaccgctaggatgcattctcagaaactggtcttgggtcaactcaaggttgttaaagaagaaattgctagtttccctctctaacaacgtttggccacaatataaactaaatgatcagagagtgtggctaggaaatgggacttcagattccaataccatttcttgtttatatctatactgccgtgagcacggtaaatggacagaaatcccttatgtacaagtctttatggcaactcagggaaaatcatgagccctgtcaaagttgcaaacaactcagcaatgctaacttcatttgagttattatctggagtccactgtaaagctaagacaaaggagctgccatctagtgctcccctagaagccccagagcgaccacaccctcagcctcctgtggagccaacagcctcaccctgcccagaggaaaaaccccggagctggagcatgagccttagcatcagggcaagccccagcacaggcgtgagcccgggtgggagagtggagggtgcaggaatgtttcccctacaggaagtgataggacccaacggccccaccaaaataggggtcccctttaaaatgcaggatttaaatgagatgaaagcagaaatgggaagcttcactgaggaccccaacaggtggtgagagggatggtataactggtatgtttgagcttacatggaaggacatagcattccttctaaacactatcctaactcatgggccaaagcagatggtgtcacagcatgtcaatgattatgcaaacgccttgcataggcaagatgagggacacccaatggcagaggcagcgatcccaattaaggaaacttcatggaactatagcactcctgagggaaggaaaggtagagaccacatgctggcttgtcttctagcaggactaagggcagccagtaaggcaagaccaaagaactttaataagctatcaatgatagaacaggggccgcaggaaaatccagctgcctttctagaaaggtcaaagagggtcttgataagtatactgatttagatcctgactctgatgtaggaaatgccatactaggggacagattcctaactcaagccacccctgatattagaagaaagcttcagaaattagggatgggaccaaacacccccttggctgacattatcaaggctgcttctaccgtttattttaacagagaccaggaggaggaggagtgagacaaacaaaaggaagagtgtaaggataggcagcaggcccagttgatagcttgaagttataactagaagttttggtttatataagttatagtttatataacttctgctcagttagcagaactgatcgccttaaccagagctctaaaactaggtaaggacaagataattaacgtatatacagattcaaaatatgcctttttagtcttttatcctcatgcagcagcaatatggaaaaaggagatatttgacagctagagacacccccatcaagtatggagctcagatcctcaagctccctgagcctgtaaatctgcccagagagactgcagtcacgcactgcagaggccaccaaagaggctctgacgagatttcccgaggtaactcttttgcagactcagtagctaaaaaggctgcaatggaaaggcataaaagggcttcctgactcttgtcattttgggagagataaacttaaaaagctttgtgataaattattttgtggaaagggcctagcaaaaaccatccacagagtctgtcagaattgcactctgggtgctgtaattaactcccaggggtgtcgacctctgccattaattaaacctatgcagcaaaagggaacttactccggggaaacctggcaaatagattttacacagatgccactctgtcaaggctataggtacttgcttgtacttacagacacttttactggatgggtagaagccttcccaaccagaaccgagagagctcaggaagtggccaaaattctcctgaaggaagttattccacgctttggtctcctaaaatcttcacaaagcgacaatgggccttccttcatctcccagattacacaagggatttgtaaggccctaggaataacctggccccttcactctgcatggagacctcagtcttccggtaaggtagagagagccaaccagactctgaagaagaacataaggaaactctgccaggaaactagtcaaaactggatttctatccttcccattgctctactcagaattaagacaggaccctcctcccagctctccttaagcccctttgaggctctttacggaaggccttttctgcattcagacatcctggtggatacagaagccaacaacgccatcaaatattttatttccttggctcaatttcagaaggcaattcaggatgtcgggctccacataggccagggtgccagcccatcccacttatatgagccaggaacacaggtcctacttaaaacctcgaaagatggctctcccaagtcccagcttgctcccacatggaaagggccatacactgtctcactgtccacacctacagagatcaaagtgtctggcatccccagctggatccaccacaccagggtgaagccgtacttccctgaagaccagcaggatccagaacctaaagagacttggtcagcggagcctctggaaaatttgtgcctactctttaaaaggagcccagataaataaagatgccctttcaaagccttcccttcttctttctactggcatgcctcccacctggactcctaactgatgcctcaccctttattaggccactccaggctgcggttaatttattggccaacatctcctgtagctgctcttgctggatttgcctggagatgcagggctcatctggggaagcatggccaccctctctaaggaaatgggctcagacagatggatttatgtactactcaacttctactgggcatcagggtgttcatgcatcagttataaaggatggcctctcacaccttgttataggacctagctatactaaggtcatgttaagggcaaaaccccccctgtgcctcagctctcctgagtttcctcagggagaccctgtgggagccctaaatagctctttttgtaactttactgtaacggtgcacaccaaggattgggcagtctccctcaagccccccttgctcttctcctctcctccaaacatatctgtggcacatcagctccattacactgggggcttctgccagggaaggcctgtgtcatgtaaacattttgctctaaaggctgattctcattgggcagcataggaatagataattgctccttcattcatgaggaggcaagttggcccggactctcacctacaccactagacaggtaatgttctgggaagatcggacgagcagtacttcccataacaacaccccatgttttagtccagtaactgcagcttcctttgctgccacgtatttcttcaaacgcaccactactgaaaattcccaacatagtatataccacctctttggatgcctccctcccacaggggggatatactttgtctgtgggactcttgcttaccaatgcttaccttctaactggacagggctctgtaccatggcctatgtcctgtctactatatctgttgctaatgcttcagcccctacaccgattcccttacacactacttctcaactctccaagaggatttcccctctaatccctgtcctggtagggatcagcatggtggctggagtgacacgagttgctacaggcacaacaggggcagtatcagcaaacaatatgtctactagcctctcctccaaactggctggtcttaacacccaaatagcagcttctctcttcactctcacaaatcaaataaactctttggctgcagttgttctccaaaacagacgagcactggacatgctaactgccactcaggaaggtgtctgtgccatgctccgggaagaaggttgtttctgggtcaatcagactggacaggtacaaacccaaattcgtactttcctgcacaaagccaagtacctccaggaccaagccatgcagggctgggatttctggcctgacatctagtcatggaaatcctggctattttctctccttggtccaataacttctgtaatcttgctgcttctctttggaccatgtgtttttaatgaccttgttcattttgtctttaacagaataaaaggtgtcaaactccaaatggtcatcagacaaggctttcaacccattccactggacttcctgagtagccctctggaccgagcaggacagtctttccaaggccactgttgcacaccataagacagatagcaagaggaaatacccaaatcctcctcgacgcccatatgccagctttgaagaagctacagaaaatggaactccatccataatcccaaagaagaattttgggtattccctcttgagggggaatgttaggtaggaagtcagatatgagcttatgtgtgtgtgacaaaggcctaaagagaagatgtctatgtccagcacatgcatctgcatctcaaagtcatcctgacaatgtttcaggggcagcccagtattcgcatcctgtcctgcccccttctacctccttctacctgataacctgccaggtgggggtcctgctccttctgcctgacagtcttccaggtgcagcccagtatgtgcatttcaaataccctgctcctgaacctgagtccccaggaggtcttgataacccttcctctaaacccaggggggtgccagctaggcttcctcctgtctgataccttcaggggaaaactcagataggagtttctagtattcacactcaaaaagtcctttttttcaggagatgtgtgaagacaaagacccatctccttaaaagtcccttgtctcaactggactgtgtgctcagtcctctgcctctctgctgagccgcccgcctggcctggtcaggtatattctccactcaaccatgtaaccctctggtcatccacagctgccctctgggttttctttgcacaaacccatatcggagaacgaggccccgcacactggtgattctctcttgtaccattctgtaggtcttaattgcttttaaaaatgtatataaatgcaaccaatttggagcctgcggcaaggaaaatggtggacgggaaggcgggagagagaagcccatggggccgcagtgagctggagccccaggtaatggaggggaaacaaccaggattagtgctgaaaaccatcatctgagaggaagctgagccttcccaacaaaacctacaaagacctgcaggtctgcattggccacaggtggtcagacatccaagcaagcttcagccacatgcgccagctgggtcaataagcctgcagagactgctccacctctggctgcaaacgccctctcaggagcagggcttgtaatggagatgaagatggggaaccggagcagaggcctccaggagccaaggtgaggaagaggagccctggaaggattcgccagcatcagccaacacatccctgcaggagggaaagcacgggttttctgaggagcagaggctctgggagccagatatcaaacctcatcctggaaatggccgtgaccaagacaactgaatgacgcgttttgaaattggggttggatgtggggtggatgtcaagttgaaaggaacaggttccctttttgaagaatggtataaggcagagtttcaaactgctttgttttcttctttttcatatgctttaaagatgagtggtactctaaaaaatgagaatttgaaattgaaggacagttgtgttctatatatggctttcagacatttgttgattttgtagctttggttgatcagtttccaaaggctacagataataaagaaatcagaagtggcaccagttaaggaatagcgtatttttagacacaactactagcacatcaagagggaagcacaactttactgtgttaactctctgaactccctccttccctgaactggcagcctcccaggagcagccttatacagagaaggggtattgtactgagaaaaagggactgactattgactgagagtaaattgggatgaactaagctcagcctttttcttcctgggcatttgttgggtttgaagtcaccagaaactcggtgttgcattgctgtcagcgggtaccacggcttagctctttttaaaaaaattaactttgtacgtaaactatcgagtattagacatagcctacttcaccataggggtcttgtctgccttcattagttgtccaaggccaaccgtttgctaccaaagtgaatcagtatttcgaaggtgcttctcttggtatttggttattagatagtttctgtatgcgtttcccccagactgaggcaaatcagaaagaagctgtttcttttaaaatacaaatcaccaagaatgtaaatgtccctattgctcaaatatttggcttttttttattattgtttaaaaggtataaacaccaaaaaggtcagcattacataaggatggaaaaggagaagatgtgctttctgtaactttgtctacgcatttaagttaccacgttgtgatgtcatatttgaattcaactcactacataccgtcttattagcacttatatcatttagtttaagagcatacatattccagcactatgttgcagtgggttaaagccccggcagaagcgccagtatcccatatgggtgccggttctagtcccagctctccacttcctatccagctctgtgctatggcctgggaaagcagtggaagatggcccaagtgcttgggcccctgcacccacgtgggagatctgaagaatctcctggctgctggctttggaaagacaaagctctggtcattgcagccatcttgggagtgaaccagaggatgaaagacccctttctctgtctctacttctctctgtaactgtgtctttcaaataactaaaataaatctttaataaaaaagagcatacatgttgatcaaaacctctctgaagctcattttaggcactaaatacgaagaaaatgcaccttcaaacatattagatttgcatattgtaggctctttctttgtatttgttattgcatatgacctcttttttttttttttttgacagttaaacccatctttaaaaacaagtcacaggcagaaacaaagtagtataaggacttccttgaagactcctgagatgttgaatgtggaagcagctccagactctgactggggtcaccactccttgagctcttctctaggtgatagctccagagaagcagcctgcgggtgttcctaacgcttcgtgcactgacctctaagtctagagtaagccccagtgaaacatggaaatgcatatagaactgttagctcttccatggttttattaatcaagtacataaattcaacttaccttaatgtaagcaaagtatccattttttgcccatcaacgatagactggataaagaaattatgggatatgtactctttagaatactataccgcagtaagaaacaacgaaatccagtcatttgcaacaaaatggaggaatctggaacacatcatgctgagtgaaataagccagtcccaaagggacaaataccatatgttctccctgatcggtgatgactgactgaacaccaagagggaaacctgttggagtgaggtggacactatgggaaatggtggcttgatcagcatagccctgactgttaatgaacaacttaatacattatccctcttagtagttttttttatctgttctacttaatatgactggtttagatctgtaattgatgcacagttattcttaagtgttgaaaattaactgaaatgtgatccctgttgaacatggtggtgggaatgggagagggaagagatgtataatttgggacatgctcaggctgacttgccccaagtggtggagttggaagcataccaggggattccaattcaatcccatcgaggtggcatgtaccaatgccatctcactgttccaggtgatcagtttcagttcacagttggtcatggtgaagggactgggagtcaaagggaacacattttttgtccatttttaaaaatatttatttatttatttgaaaggtaagagttacagagaggcagaggcagagagagagaggtcttccatccactgggtcactccacagatggccataactggggatctatcccagcaaagccaggagtcaggagcttcttcttggactcccttgtgggtgctggggcccaaagacttgggcctgttatacccagtacgattgtccacaaagtccgccaaggagcggatatggctgtaaaagaaacaagagttttattacatggatttattaaacaagttacatgaatttacttaatttaatgtaagcaaagtatatatttgttgtccatttttaaaaacatttatttatttgaaaggtaagagttacagagaggcagaggcagagagagaggtcttccatccactgggtcactccacagatggccacaactggggatctacccctgcaaagccaggatccaggagcttcttcttggtctcccgtgtggatgcagggccccaaagacttagtgttatacccagtacaattgtcccagaagaccgccaaggagccgatatggatgtaaaacaccaaggagccgatatggatgtaaaacaaacaagagttttattacaagctcggacctggactctcaactgtcaccaatgcagcagatttgaattgagagccctgactcttctgtaaatggtacttttatagggttttcagagacattctatacatgatagcaccattcagcaaattatctcattccacaggaaattcaaagaacatctcttaaaattgattaatgcatccagcggtgggaatggacctagtaaaggttgttggatggccttggggttgatgccttataaaatgattggataaagtatcgaagccagtagggtgtacatgtcaaactgccgggtttctggatataatcaatcaccttaactgcctgaagacacctggaacttcaggtatttccctgctatgtcctaattggctgtgcttggggaggttattccaaggggtgtttatttttcttctttcaggagcttttggcttggggttcagggcctggtcaggcctgagttacaaggtgaaacctactctaaaatagctctgcttgatccaggcacaggtctctcaggccatcttccattgctttcccaggtcctagcagacaggtggatcggaagtggaatagctgggtcttgaaccggcacccatatgggatgccggcactgagggcagcggctctacttgctatgtcacagggccggccccacattgacatattctcaatgtactctaaacactagctcagccctccactctataaggatttcaacacagagtagcagaaacaccactgttcctcaagagcctagacaaggctgagtctcaatcctcccaggccctctgtcactaccagacctgaggtgcactaacaccccctgagtgagtcacaggtagaattgtgtcagttttcaatctctgatggagtagttcttcatttaatccaaaatcaaatagaacattctcatccaattgcaccaataggagcttcattgttggtacataagggcacacaatgaatagtatcacaaattcttaagcctggaataattggaacaagtcgaatagagccctgtatgtcatatctttcactttaatgggctgagcgtataagaaacaaaccaatgacgttccaactgtgctcccactgtgctctgtgatgcacctcccatggagcagggccagtgctcaggacaatggggctgtgggtgtgcaggtgcacgtgtgcctccttctgtctccacctagacagggcagaggcagaggcagaggagagggaatggatcgggcaactccccactgtgtttcctgaaaaataaactcattgtactctcggtgatggtcgggtagccaaattgtcctgacaaaagcttttaaatattctcctgtccctgtagcatgaggtcagccaacacacaggtcagaggcaatcagtgcccagacactggaaaccaaaaaatggagcccagttttagcatagggtgacttttactgtggataatacttatttctgtgaagataatatgctcaaaatctaacatttaccatttttcaaaatatttatttatttacttgaaagattgagtattggagagaggcaacacagacaggttgagagggcaaaggagaaagagagagaaagagagagagagagaaagagaaagagagaaatgttatgtaatctggtgctctccacaaatggctgtatccgtgagtgcttggccaagctgaagcccaggactagaactgcccctgggtctcccctgtggggcaggaatccaggaacttgggcctttttctgctttctcccagggtgtgtgttagcaggaaatgggatcagaagtggagcagtggggattcaaaccagtctctgatgtaggtggctggcactgcaagtggaagccttatccactgtgccacaatgccagccttccctcctctcctgatttctttatttatttgaaagacaagtaaaagacatggccctaggcttaaatatgttaactatctcgagaaaagggactttctcttccagaatcccaacataaccatgaataaatgacgacaaattgtcttccagctcagttaaagttttagcaaatgtccctcaatccctgatagagcagttcttcatttaatctgaaatcaaattgaaaattctcatggaattgaaccaatagtaacttcattgtttgcacgcaatgttacacaactaatggattcacatctcttgtagatgtagactaagtggaaacatcgaacagagcccttcatctcacagatcttccatggtagtgggcagggctgatggtactcaaaccaataatgttctacctctgctcctgatattggaatttgaccttccaaaaatataatttggggtgccatacgatatcaccatatgcttattaataagttccccatattaataagcccatgtgggttcttgcctaattttcagagaattctaaatactggcataggtgaacgaggcagcatggtacattttaagcttttattcagtgagaaagatgcataggagagtgagggccccgtctaaaggagggaggtagatgtgggttcataccaagtaccaggaaccagccacgtggaggaacatctaggccaggaagcgtggggcgggtagccaaaggcaacacaccatggaggcacagggctgcagccagccccctactggcaagaagccagtgagagaagggagggaaaaaggccagacacaccatgtcccaggcttttaatccacttccaaggggagtggttaattcacctgattgaccggtgcccacccagttgtggccagcagtggagcagtggggaatcaaagcagtctctgatgtaggctgctggctttgcaagtggcagctcaatccactgtgccacgatgccagccatccctcctctctggattttcttaagacaaacgtgaacgtttctgaagagaggagagagggaagttaatttccttgatgttcctgagacctatgatgaagccttgaactttcacttcttttttcgttatgcaacctgatcagaactcaggctgcaggtgggagagcgcacctgtgtgatctctcctctaagcacctgcgttctccttctgagtcctggtctctctctggcagccgcttgttctgaggatgtttattctgagtcagtacagaggtgagtgtggacagaagtctcatctctcagagaccatctccctggtgcagcggtctgccgtgaggggacaatgtgagggcatcagaacacaagtaaagaaatggctctaggcaaaaattagtttactatctattttaaagaaaaggaactttctcctacatatcccagataaccatgaatttattactacatcttgtccgataaactcacgattttggcaaatgtccctcagggaattttggttgtgacctctcctggtagaagcatgtgcactgcaggtaaacttgtgcagccctggtctgagctggggcagctggagacacagtccctgggctgagctctgagctgccctgggcccttcagctgggcacagccctgccccacccctgctcatttgcatgtccccagagcaccgcccacctctctgggcatttaggagcaggctgctcccgccccatgcaggaggcagtgccaggcaggacccagcatggacatgagggcccccactcagctgctggggctcctgctgctctggctcccaggtaaggcaggccagcagcaggaacggcctcgggcagtgtggccagggctgcctgtctctgcaggagcgtcctcttagaatgtgaggatgagtgtggtctctgtgtttctctttcccttctcagg

SEQ ID NO: 118 - DNA, 2517 bp, Oryctolagus cuniculus
ccacagtgatacaagccctaacaaaaaccagcaggaaagcagaagtgtgaggctgggctgccccagctgcccctcctgggccccatctgctgagagtgattcacagagcagccaggcttgaaggtcctgcagggtcgggtggaaggggccaggctgactcctctgaggcgccctcctttcctcctttttggcggctgcagcacacacttttggtaacccagcctgcctgctgagatgcacagtcagttaggagaattctctccaatccctcagcacctgcacacaggcacagtgtccccaggagtccacatcagacccaggttgcacaggtttcctacagagaatgtctctctggggtctcagcagagagaggaccagtgtgggtagaggtccacgctctcctcatggctcagcccagctttgctgctgctgctccacctgtgacaggggctgcaaggcttgcacagcccagaaccttcgagaagctgagcagctgctcagtgtggttcgggtggacgtcactgaggccagagaggcttctgctttctctcattccctaatggcctttgtaacataaaagagcaataaatagaaaacatagtgagggctatgatttataaaaatggctgtgcttggatcctgccacacactgggagtcctacatggagttttgtgctctggagtatggctgacccagcctcagctgacaggctcatccgggaaagtaccagcacgtggatgatctctctctctctcttcctctctctcactttgtccttcaccaatgctcagtctttcaagtaaataaataaataaatacttttaaaaatgggaaatattacatttaaggaaataaatgggggtcacatgtgcaattgtgtcagttttcaatctgatggagtagttcttgattcaatgcaaaatcaagaagaacattctcatccaattgcactaatagcagcttcactgttggtacataatggcacacaaagaatagtagcacaaattcctaggcctgaaataattggaagaagtcaaacaaagccctttatgttatagatctttcattttagtgggccgagtggataagaaacaaaccaatgacgttccgactgtgctcccactgtgctctgtgatgcacctgccatagagcagggccagtgctcaggacaatggggctgtgggtgtgcaggtgcacgtgtgcctccttctgtctccacctagacaggggcagaggcagaggcagaggcagaggagagggaatgtatcgggaactccacatctgtgtttcctgaaaaataaactcattgtactcctggtgatggtcgggtagccaaattgtccctgacaaaagattttaagatttctcatgtccctgtagcataaagtcagtcagcacacaggtcagagggaagaatcagtgcccggacactggagataaaaaaaaatggagcccagttttagtgtgcattagcaggaaatgcgatcaaaagtggagcagtggggttcaatccagtctctgatgtaggctgctggctttgcaagtggcaacttaatccactgtgccacgatgccagtctaccctcctctctagattttcttagagataaagtgaaggtttcaggagagaggagtgagggaaattatttttcttgatgtcttcagacctatggtgaggccttgaactttcacttttctttcctcttgcatccttgactcagcactctggctgcaggtgggagagcacacatgtgtgatctctcctctaagcacctgagttctcctgagtcctggtctctggcagtcgcttgttctgaggatgttaattctgatcagtttcagaggtgagtgtgggacagaagtctctaatctcagagaccatctccctggtgcaggggtctgctgtgaggggacaagatgaggcatcaaaggacaaacaggtaaagacatgggcctcagttttaaggtgtaactaagtattccctagaaaatcgactttctactaaagaattccaccataaccatgaacaaattacaccttcttgtcctccagttcaattacagggttggcaaatgtccctcagggaatttgggaggtgatgtctcctggtagaagcatgcacactacgggtaaacttgtgcagccctggtctgagctggggcagtggagacacagcccctggactgagttctgagctgccctgggcccttcagctgggcacagccctgccccacccctgctcatttgcatgtgcccagagcaccacccacctctctgggcatttaggagcaggctgctcccgccccatgcaggaggcagtgccaggcaggacccagcatggacatgagggcccccactcagctgctggggctcctgctgctctggctcccaggtaaggcaggccagcagcaggaacggcctcgggcagtgtgtccagggctgcccgtctctgcaggagcgtcctcttagaacgtgaggatgagtgtggtctctgtgtttctgtttcccttctcagg

SEQ ID NO: 119 - DNA, 2083 bp, Oryctolagus cuniculus
acacagtgttccaagccctaacaaaaccccccaggaaagcagaagtgtgaggctgggctgccccagctgcccctcctgggccccatctgctgagagtgattctcagagcagccaggcttgaaggtcctgcagggtcgggtggaaggggccaggctgactcctctgaggctccctgctttcctcctccttgacggcggcacagacacggtcatgtctctactgttctaaaggaaaccaatttttctttctgattatcaaagctagagcctcattaacgattcatagagcaaaagagcaatcagtatatgtattccaagccaaatgagtttaactgcaagtgataatataaattctataaagagtatcaatttcacagctatagtttttaaaaaagatttatttgcttatccaaagtctctgctacacacacacacacagatgggggggagaggaaggggaggagagagagagagagagagttagaatgaaactttgagggagagatagacgatagacttatcttccgtcctctggttactccccaaatggctgcaatggccgagcagtgcctggcagagctaggagagagaactcctttcattctcccacatggtgccggagctcaaacacgtgggccagctccaggtgctttccaggccaagcagggagctggattggaagatgagaagcctggactcccaccggggcccatgtgggatgctggtactgtgtgaggtggctttacccactacagaggttcagcccatcctatccacagtggtgagaccataatgccacttcccaccatgtcctccctcctgtgcgggccagccacaccagtcgaatggaacctaagggagggagagggaccgaaaatagggacaggagatcgcagagaatggagccaagacaacaaggctgatcaaggctcgtttattcctatgtctcattggtatttatacataaccagcacaaagaagcacaaaagataacaacatatgtaagcaacttatcggggctctggtaacgcagatactgttaacagagcgttcttgattaacatcgtccttcaggatgggagcatgtgactttcttatcccaagaactccacaagccaagactggccttgatttgtccaaaggctgcctgcacctccttctaccaccccccccccccgccacttctcttctgtttcgtttaagttctacactgacatactttcactctataatcaccagcttcaccctccactagacatagaattccgcggatccttctatagtgtcacctaaatgtcgacggccaggcggccgccaggcctacccactagtcaattcgggaggatcgaaacggcagatcgcaaaaaacagtacatacagaaggagacatgaacatgaacatcaaaaaaattgtaaaacaagccacagttctgacttttacgactgcacttctggcaggaggagcgactcaagccttcgcgaaagaaaataaccaaaaagcatacaaagaaacgtacggcgtctctcatattacacgccatgatatgctgcagatccctaaacagcagcaaaacgaaaaataccaagtgcctcaattcgatcaatcaacgattaaaaatattgagtctgcaaaaggacttgatgtgtgggacagctggccgctgcaaaacgctgacggaacagtagctgaatacaacggctatcacgttgtgtttgctcttgcgggaagcccgaaagacgctgatgacacatcaatctacatgttttatcaaaaggtcggcgacaactcaatcgacagctggaaaaacgcgggccgtgtctttaaagacagcgataagttcgacgccaacgatccgatcctgaaagatcagacgcaagaatggtccggttctgcaacctttacatctgacggaaaaatccgtttattctacactgactattccggtaaacattacggcaaacaaagcctgacaacagcgcaggtaaatgtgtcaaaatctgatgacacactcaaaatcaacggagtggaagatcacaaaacgatttttacggagacggaaaaacatatcagaacgttcagcagt

SEQ ID NO: 120 - DNA, 12829 bp, Oryctolagus cuniculus
gctttgattgcctgaggactgaatctggaaaggagataaaattagctatctgttttaattgactgagtgattgcagtagccctaattggatctggttttggttgaaatattcgagctgtgtgggttaagatctcaccttggtggccattttaattagactagatagttcgaacttctttgttgcgttaaaaaggttttgctagcttatattgtgtctacccaagggtctggttccttatgtgctgttaatgggatgcagcttcagagttgacgtcattcccccatgggtttttgtgtcaggtctggcttgctctgtgtgctgaatcgtgtgatagtaggggcagtgggaagcgtgtgccctccctccttctggtgtctgaccagggcctggttggcaccaggacaggaagctggttacctctccctgctgcacttctgtctttactctggcccttccctgttccctctaggcataggtctggactgggagccatctgatagactttgctattgggccatacccttcaaagtagaaagagaactttagtttagcttagtccaagcagatttgcaggctaggattctgttgtttaagatgaggggctgactggctttgccaaattaacattaaaatagtcaggggccatcaggccaagtctgattaagggataatactgagaacaggactccaaaagggagagatttagagatgttttgaggcagttatgcagcagataccagattactgggtttcaggaaccccaagagtgtttgcaggttacacggtaatactagttaagtcctgcaacccaggcccatcccataacccactggctacatggggagccaaggaataatttggaggtgggcagggacgcctgctccctccctagtgtggcagaaacccctgccatgacttctcctctagtctctttcagatgggaaaccaggtctcattaccatcacgtgactcaccactaggatgcattctcagaaactggtcttgggtcaactcaagattgttaaagaagaaattgctagtttccctctctaacaacgtttggccacaatataaactaaatgatcagagagtgtggctaggaaacgggactttagattccaataccatttcttgtttatatctatactgccgtgagcacggtaaatggacagaaatcccttatgtacaagtctttatggcactcaggaaaaatcatgagccctgtcaaagttgcaaacaactcagcaatgctaacttcatttgagttattatccggagtccactgtaaagctaagacaaaggagctgccatctagtgctcccctagaagccccagagcgaccacaccctcagcctcctgtggagccaacagcctcaccctgcccagaggaaaaaccccggagctggagcatgagccttagcatcagggcaagccccagcacaggcgtgagcccgggtgggagagtggagggtgcaggaatgtttcccctacaggaagtgataggacccaacggccccaccaaaataggggtcccctttaaaatgcaggatttaaatgagatgaaaacagaaatgggaagcttcactgaggaccccaacaggtggtgagagggatggtataactggtatgtttgagcttacatggaaggacatagcattccttctaaacactatcttaactcatggggaaaagcagatggtgtcgcagcatgtcaatgattatgcaaacgccttgcataggcaagatgagggacacccaatggcagaggcagcgatcccaattaaggaaacttcatggaactatagcactcctgagggaaggaaaggtagagaccacatgctggcttgtcttctagcaggactaagggcagccagtaaggcaagaccaaagaactttaataagctatcaatgatagaacaggggctgcaggaaaatccagctgcctttctagaaaagtcaaagagggtcttgataagtatactgattcagatcctgactctgctgtaggaaatgccatactaggggacagattcctaactcaagccacccctgatattagaagaaagcttcagaaattagggatgggaccaaacacccccttggctgacattatcaaggctgcttctaccgtttattttaacagagaccaggaagaggaggagtgagacaaacaaaaggaagagtgtaaggataggcagcaggcccagttgatagcttgaagttataactagaagttttggtttatataagttatagtttatataacttctgctcagttagcagaactgatcgccttaaccagagctctaaaactaggtaaggacaagacaattaacgtatatacagattcaaaatatgcctttttagtcttttatgctcatgcagcagcaatatggaaaaaggagatatttgacagctagagacacccccatcaagtatggagctcagatcctcaagctccctgaggctgtaaatctgcccagagagactgcagtcacgcactgcagaggccaccaaagaggctctgacgagatttcccgaggtaactcttttgcagactcagtagctaaaaaggctgcaatggaaaggcataaaagggcttcctgactcttgtcgttttgggagagataaacttaaaaagctttgtgataaattattttgtggaaagggcctagcaaaaaccatccacagagtctgtcagaattgcactctgggtgctgtaattaactcccaggggtgtcgacctctgccattaattaaacctatgcagcaaaagggaacttactccggggaaacctggcaaatagattttacacagatgccactctgtcaaggctataggtacttgcttgtacttacagacacttttactggatgggtagaagccttcccaaccagaaccgagagagctcaggaagtggccaaaattctcctgaaggaagttattccacgctttggtctcctaaaatcttcacaaagcgacaatgggccttccttcatctcccagattacacaagggatttgtaaggccctaggaataacctggccccttcactctgcatggagacctcagtcttccggtaaggtagagagagccaaccagactctgaagaagaacataaggaaactctgccaggaaactagtcaaaactggatttctatccttcccattgctctactcagaattaagacaggaccctcctcccagctctccttaagcccctttgaggctctttacggaaggccttttctgcattcagacatcctggtggatacagacgccaacaacgccatcaaatattttatttccttggctcaatttcagaaggcaattcaggatgtcgggctccacataggccagggtgccagcccatcccacttatatgagccaggaacacaggtcctacttaaaacctcgaaagatggctctcccaagtcccagcttgctcccacatggaaagggccatacactgtctcactgtccacacctacagagatcaaagtgcctggcatccccagctggatccaccacaccagggtgaagccgtacttccctgaagaccagcaggatccagaacctaaagagacttggtcagcggagcctctggaaaatttgtgcctactctttaaaaggagcccagataaataaagatgccctttcaaagccttcccttcttctttctactggcatgcctcccacctggactcctaactgatgcctcaccctttattaggccactccaggctgcggttaatttattggccaacatctcctgtagctgctcttgctggatttgcctggagatgcagggctcatctggggaagcatggccaccctctctaaggaaatgggctcagacagatggatttatgtgctactcaacttctactgggcatcagggtgttcatgcatcagttaaaaaggatggcctctcacaccttgttataggacctagctatactaaggtcatgttaagggcaaacccccccctgtgcctcagctctcctgagtttcctcagggagaccctgtgggagccctaaatagctctttttgtaactttactgtaacggtgcacaccaaggattgggcagtctccctcaagccccccttgctcttctcctctcctccaaacatatctgtggcacatcagctccattacactgggggcttctgccagggaaggcctgtgtcatgtaaacattttgctctaaaggctgattctcattgggcagcataggaatagataattgctccctcattcatgaggaggcaagttggcccggactctcacctacaccactagacaggtaatgttctgggaagatcggacgagcagtacttcccataacaacaccccatgttttagtccagtaactgcagcttcctttgctgccacgtatttcttcaaatgcaccactactgaaaattcccaacatagtatataccacctctctggatgcctccctcccacaggggggatatactttgtctgtgggactcttgcttaccaatgcttaccttctaactggacagggctctgtaccatggcctatgtcctgtctactatatctgttgctaatgcttcagcccctacactgattcccttacacactacttctcaactctccaagaggatttcccctctaatccctgtcctggtagggatcagcatggtggctggagtgacacgagttgctacaggcacaacaggggcagtatcagcaaacaatatgtctactagcctctcctccaaactggctggtcttaacacccaaataacagcctctctcttcactctcacaaatcaaataaactctttggctgcagttgttctccaaaacagacgagcactggacatgctaactgccactcaggaaggtgtctgtgccatgctccgggaagaaggttgtttctgggtcaatcagactggacaggtacaaacccaaattcgtactttcctgcacaaagccaagtacctccaggaccaagccatgcagggctgggatttctggcctgacatctagtcatggaaatcctggctattttctctccttggtccaataacttctgtaatcttgctgcttctctttggaccatgtgtttttaatgaccttgttcattttgtctttaacagaataaaaggtgtcaaactccaaatggtcatcagacaaggctttcaacccattccactggacttcctgagtagccctctggaccgagcaggacagtctttccaaggccactgttgcacaccataagacagatagcaagaggaaatacccaaatcctcctcgacgcccatatgccagctttgaagaagctacagaaaacggaactccatccataatcccaaagaagaattttgggtattccctcttgaaggggaatgttaggtaggaagtcagatatgagcttatgtgtgtgtgacaaaggcctaaggagaagatgtctatgtccagcacatgcatctgcatctcaaagtcatcctgacaatgtttcaggggcagcccagtattcgcatcctgtcctgcccccttctacctccttctacctgataacctgccaggtgggggtcctgctccttctgcctgacagtcttccaggtgcagcccagtatgtgcatttcaaataccctgctcctgaacctgagtccccaggaggtcttgataacccttcctctaaacccaggggggtgccagctaggcttcctcctgtctgataccttcaggggaaaactcagataggagtttctagtattcacactcaaaaagtcctttttttcaggagatgtgtgaagacaaagacccatctccttaaaagtcccttgtctcaactggactgtgtgctcagtcctctgcctctctgctgagccgcccgcctggcctggtcaggtgtactctccactcaaccatgtaaccctctggtcatccacagctgccctcggggttttctttgcacaaacccatatcggagaacgaggccccgcacactggtgattctctcttgtaccattctgtaggtcttaattgcttttaaaaatgtatataaatgcaaccaatttggagcctgcggcaaggaaaatggtggacgggaaggcgggagagagaagcccatagggccgcagtgagctggagccccaggtaatggaggggaaacaaccaggattagtgctgaaaaccatcatctgagaggaagctgagccttcccaacaaaacctacaaagacctgcaggtctgcattggccacaggtggtcagacatccaagcaagcttcagccacatgcgccagctgggtcaataagcctgcagagactgctccacctctggctgcaaacgccctctcaggagcagggcttgtaatggagatgaagatggggaaccggagcagaggcctccaggagccaaggtgaggatgaggagccctggaaggattcgccagcatcagccgacacatccctgcaggagggaaagcacgggttttctgaggagcagaggctctgggagccagatatcaaacctcatgctggaaatggccgtgaccaagacaactgaatgacgcgttttgaaattggggttggatgtggggtggatgtcaagttgaaaggaacaggttccctttttgaagaatggtataaggcagagtttcaaactgctttgttttcttctttttcatatgctttaaagatgagtggtactctaaaaaatgagaatttgaaattgaaggacagttgtgttctatatatggctttcagacatttgttgattttgtagctttgtttgatcagtttccaaaggctacagataataaagaaatcagaagtggcaccagttaaggaatagcgtatttttagacacaactactagcacatcaagggggaagcacaactttactgtcttatctctctgaactccctccttccctgaactggcagcctcccaggagcagccttatacagagaaggggtattgtactgagaaaaagggactgactattgactgagagtaaattgggatgaactaagctcagcctttttcttcctgggcatttgttggatttgaagtcaccataaactcggtgttgcattgctgtcagcgggtaccacggcttagctcttttttaaaaaattaactttgtacgtaaactatcgagtattagaaatagcctacttcaccttaaggggtcttgtctgccttcattagttgtccaaggccaaccgtttgctaccaaagtgaatcagtatttcgaaggtgcttctcttggtatttggttattagatagtttctgtatgcgtttcccccagactgaggcaaatcagaaagaagctgtttcttttaaaatacaaatcaccaagaatgtaaatgtacctattgctgaaatatttggcttttttttttattattgtttaaaaggtataaacaccaaaaaggtcagcattacataaggatggaaaaggagaagatgcgctttctgtaactttgtctacgcatttaagttaccacgttgtgatgtcatatttgaattcaactcactacataccgtcttattagcacttatatcatttagtttaagagcatacatattccagcactatgttgcagtgggttaaagccccggcagaagcgccagtatcccatatgggtgccggttctagtcccagctctccacttcctatccagctctgtgctatggcctgggaaagcagtggaagatggcccaagtgcttgggcccctgcacccacgtgggagatctgaagaatctcctggctgctggctttggaaagacaaagctctggtcattgcagccatcttgggagtgaaccagaggatgaaagacccctttctctgtctctacttctctctgtaactgtgtctttcaaataactaaaataaatcttcaataaaaaagagcatacatgttgatcaaaacctctctgaagctcattttaggcactaaatacgaagaaaatgcaccttcaaacatattagatttgcatattgtaggctctttttttgtatttgtgtattgcatatgacctctttttttttttttttttgacagttaaacccatctttaaaaacaagtcacaggcagaaacaaagtagtataaggacttccttgaagactcctgagatgttgaatgcggaggcagctccagactctgactggggtcaccactccttgagctcttctctaggtgatagctccagagaagcagcctgcgggtgttcctaacgcttcctgcactgacctctaagtctagagtaagccccagtgaaacatggaaatgcatatagaactgttagctcttccatggatttattaatcaagtacataaattcaacttaccttaatgtaagcaaagtatccattttttgtccatttttaaaaatatttatttatttatttgaaaggtaagagttacagagaggcagaggcagagagagagaggtcttccatccactgggtcactccacagatggccataactggggatctatcccagcaaagccaggagtcaggagcttcttcttggactcccttgtgggtgctggggcccaaagacttgggcctgttatacccagtacgattgtccacaaagtccgccaaggagcggatatgactgtaaaagaaacaagagttttattacatggatttattaaacaagttacatgaatttacttaatttaatgtaagcaaagtatatatttgttgtccatttttaaaaacatttatttatttgaaaggtaagagttaaagagaggcagaggcatagagagagagagagagagagagagagaggtttcaatccactggttcactccacagatggccacaactggggatctacccctgcaaagccaggatccaggagcttcttcttggtctcccgtgtggatgcagggccccaaagacttagtgttatacccagtacaattgtcccagaagaccgccaaggagccgatatggatgtaaaacaccaaggagccgatatggatgtaaaacaaacaagagttttattacaagctcggagctggactctcaactgtcaccaacgcagcagatttgaattgagagccctgactcttctgtaaatggtacttttatagggttttcagagatattctatacatgatagcaccattcagcaaattatctcattccacaggaaattcaaagaacatctcttaaaattgattaatgcatccagcggtgggaatggacctagtaaaggtggttggatggccttggggttgatgccttataaaatgattggataaagtatcgaagccagtagggtgtacatgtcaaactgcagggtttctggatataatcaatcaccttaactgcctgaagacacctggaacttcaggtatttccctgctatgtcctaattggctgtgcttggggaggttattccaaggagagtttatttttcttctttcaggagcttttggcttggggttcagggcctggtcaggcctgagttacaaggtgaaacctactctaaaatagctctgcttgatccaggcataggtctctcaggccatcttccattgctttcccaggccctagcagacaggtggatcggaagtggaatagctgggtcttgaaccggcacccatatgggatgccagcactgagggcagcggctctacttgctatgtcacagggccggccccacattgacatattctcaatgtactctaaacactagctcagccctccactctataaggatttcaacacagagtagcagaaacaccactgttcctcaagagcctagacaaggctgagtctcaatcctcccaggccctctgtcactaccagacctgaggtgcactggcaccccctgagtgagtcacaggtagaattgtgtcagttttcaatctctgatggagtagttcttcatttaatccaaaatcaaatagaacattctcatccaattgcaccaataggagcttcattgttggtacataagggcacacaatgaatagtatcacaaattcttaagcctggaataattggaacaagtcgaacagagccctgtatgtcatatctttcactttaatgggctgagcggataagaaacaaaccaatgacgttccaactgtgctcccactgtgctctgtgatgcacctcccatggagcagggccagtgctcaggacaatggggctgtgggtgtgcaggtgcacgtgtgcctccttctgtctccacctagacaggggcagaggcagaggcagaggcagaggagagggaatggatcgggcaactccccactgtgtttcctgaaaaataaactcattgtactctcggtgatggtcgggtagccaaattgtcctgacaaaagcttttaaatattctcctgtccctgtagcatgaggtcagccaacacacaggtcagaggcaatcagtgcccagacactggaaaccaaaaaatggagcccagttttagcatagggtgacttttactgtggataatacttatttctgtgaagataatatgctcaaaatctaacatttaccatttttcaaaatatttatttatttacttgaaagattgagtattggagagaggcaacacagacaggttgagagggcaaaggagaaagagagagaaagagagagagagagaaagagaaagagagaaatgttatgtaatctggtgctctccacaaatggctgtatccgtgagtgcttggccaagctgaagcccaggactagaactgcccctgggtctcccctgtgggacaggaatccaggaacttgggcctttttctgctgcctcccagggtgtgtgttagcaggaaatgggatcagaagtggagcagtggggattcaaaccagtctctgatgtaggtggctggcactgcaagtggaagccttatccactgtgccacaatgccagccttccctcctctcctgatttctttatttatttgaaagacaagtaaaagacatggccctaggcttaaatatgttaactatctcgagaaaagggactttctcttccagaatcccaacataaccatgaataaatgacgacaaattgtcttccagctcagttaaagttttagcaaatgtccctcaatccctgatagagcagttcttcatttaatctgaaatcaaattgaaaattctcatggaattgaaccaatagtaacttcattgtttgcacgcaatgttacacaactaatggattcacatctcttgtagatgtagactaagtggaaacatcgaacagagcccttcatctcacagatcttccatggtagtgggcagggctgatgatactcaaaccaataatgttctacctctgctcctgatattggaatttgaccttccaaaaatataatttggggtgccatacgatatcaccatatgcttattaataagttccccatattaataagcccatgtgggttcttgcctaattttcagagaattctaaatgctggcataggtgaacgaggcagcatggtacattttaagcatttattcagtgagaaagatgcataggagagtgagggccccgtctaaaggagagaggtaaatgtgggttcataccaagtaccaggaaccagccacgtggaggaacatctaggccaggaagcgtggggcgggtagccaaaggcaacacaccatggaggcacagggctgcagccagccccctactggcaagaagccagtgagagaagggagggaaaaaggccagacacaccatgtcccaggctttaaatccacttccaaggggagtggttaattcacctgattgaccggtgcccacccaggtgtggccagcagtggagcagtggggaatcaaagcagtctctgatgtaggctgctggctttgcaagtggcagctcaatccactgtgccacgatgccagccatccctcctctctggattttcttaagacaaacgtgaacgtttctgaagagaggagagagggaagttaatttccttgatgttcctgagacctatgatgaagccttgaactttcacttctttttttgttatgcaacctgatcagaactcaagctgcagaagggagagcgcacctgtgtgatctctcctctaagcacctgcgttcttctgagtcctgatctctctctggcagccgcttgttctgaggatgtttattctgagtcagtacagaggtgagtgtggacagaagtctcatctaacagagaccatctccctggtacagcggtctgccgtgaggggacaatgtgagggcatcagaacacaagtaaagaaatggctctaggcaaaaattagtttactatctattttaaagaaaaggaactttctcctacatatcccagataaccatgaatttattactacatcttgtcagataaactcacgattttggcaaatgtccctcagggaattttggttgtgacctctcctggtagaagcatgtgcactgcaggtaaacttgtgcagccctggtctgagctggggcagctggagacacagcccctgggctgagctctgagctgccctgggcccttcagctgggcacagccctgcccctcccctgctcatttgcatgtccccagagcaccgcccacctctctgggcatttaggagcaggctgctcccgccccatgcaggaggcagtgccaggcaggacccagcatggacacgagggcccccactcagctgctggggctcctgctgctctggctcccaggtaaggcaggccagcagcaggaacggcctcgggcagtgtggccagggctgcctgtctctgcaggagcgtcctcttagaatgtgaggatgagtgtggtctctgtgtttctctttcccttctcagg

SEQ ID NO: 121 - DNA, 2518 bp, Oryctolagus cuniculus
cacagtgatacaagccctaagaaaacccccaggaaagcagaagtgtgaggctgggctgccccagctgctcctcctgggccccatctgctgagagtgattctcagagcagccaggcttgaaggtcctgcagggtcgggtggaaggggccaggctgactcctctgaggcgccctcctttcctcctttttggcggctgcagcacacacttttggtaacccagcctgcctgctgagatgcacagtcagttaggagaattctctccaatccctcagcacctgcacacaggcactgtgtccccaggagtccacatcagacccaggttgcacaggtttcctacagagaatgtctctctggggtctcagcagagagaggaccagtgtgggtagaggtccacgctctcctcacggctcagcccagctttgctgctgctgctccacctgtgacaggggctgcagggcttgcacagcccagaacctggagaagctgagcagctgctcagtgtggttcgggtggacgtcactgaggccagagaggcttctgctttctctcattccctaatggcctttgtaacataaaagagcaataaatagaaaacatagtgagggctatgatttataaaactggctgtgcttggatcctgccacacactgggagtcctacatggagttttgtgctctggagtatggctgacccagcctcagctgacaggtcatccgggaaagtaccagcacgtggatgatctctctctctctcttcctgtctctcactttgtccttcaccaatgctcagtctttcaagtaaataaataaataaatacttttaaaaatgggaaatattacatttaaggaaataaatgggggtcacatgtgcaattgtgtcagttttcaatctgatggagtagttcttgattcaatgcaaaatcaagaagaacattctcatccaattgcactaatagcagcttcactgttggtacataatggcacacaaagaatagtagcacaaattcctaggcctgaaataattggaagaagtcaaacagagccctgtatgttatagatctttcattttagtgggccgagtggataagaaacaaaccaatgacgttccgactgtgctcccactgtgctctgtgatgcacctgccatagagcagggccagtgctcaggacaatggggctgtgggtgtgcaggtgcacgtgtgcctccttctgtctccacctagacaggggcagaggcagaggcagaggcagaggagagggaatgtatcgggcaactccacatctgtgtttcctgaaaaataaactcattgtactcccggtgatggtcgggtagccaaattgtccctgacaaaagattttaagatttctcatgtccctgtagcataaagtcagtcagcacacaggtcagagggaagaatcagtgcccagacactggagataaaaaaaaatggagcccagttttagtgtgcattagcaggaaatgcgatcaaaagtggagcagtggggttcaatccagtctctgatgtaggctgctggctttgcaagtggcaacttaatccacaatgccacgatgccagtctaccctcctctctagattttcttagagataaagtgaaggtttcaggagagaggagtgagggaaattatttttcttgatgtcttcagacctatggtgaggccttgaactttcacttttctttcctcttgcatccttgactcagcactctggctgcaggtgggagagcacacatgtgtgatctcttctctaagcacttgcgttctccttctgagtcctggtctctctggagccgcttgttctgaggatgttaattctgatcagtttcagaggtgagtgtgggacagaagtctcgaatctcagagaccatctccctggtgcaggggtctgctgtgaggggacaagatgaggcatcaaaggacaaacaggtaaagacatgggcctcagttttaaggtgtaactaagtattccctagaaaatcgactttctactaaagaattccaccataaccatgaacaaattacaccttcttgtcctccagttcaattacagggttggcaaatgtccctcagggaatttgggaggtgatgtctcctggtagaagcatgcacactacgggtaaacttgtgcagccctggtctgagctggggcagtggagacacagcccctgggctgagttctgagctgccctgggcccttcagctgggcacagccctgccacacccctgctcatttgcatgtgcccagagcaccgcccacctctctgggcatttaggagcaggctgctcccgccccatgcaggaggcagtgccaggcaggacccagcatggacacgagggcccccactcagctgctggggctcctgctgctctggctcccaggtaaggcaggccagcagcaggaacggcctctggcagagtggccagggctgcccgtctctgcaggagcgtcctcttagaacgtgaggatgagtgtggtctctgtgtttctgtttcccttctcagg

SEQ ID NO: 122 - DNA, 6285 bp, Oryctolagus cuniculus
cacagtgttccaagccctaacaaaaccccccaggaaagcagaagtgtgaggctgggctgccccagctgctcgtcctgggccccatctgctgagagtgattctcagagcagccaggcttgaaggtcctgcagggtcgggtggaaggggccagggtgactcctctgaggctccctgctttcctcctccttgacggcggcacagacacggtcatgtctctactgttctaaaggaaaccaatttttctttctgattatcaaagctagagcctcattaacgattcatagagcaaaagagcaatcagtatatgtattccaagccaaatgagtttaactgcaagtggtaatataaattctataaagagtatcaatttcacagctacagtttttaaaaaagatttatttgcttatcctaagtctctgctacacacacacacacagatacacacacacactgtgggggggagaggaaggggaggagagagagagagagagagttagaatgaaactttgagggagagatagatgatagacttatcttccgtcctctggttactccccaaatggctgcaatggccgagcagtgcctggcagagctaggagagagaactcctttcattctcccacatggtgccagagctcaaacacgtgggccagctccaggtgctttccaggccaagcagggagctggattggaagatgagaagcctggactcccaccggggcccatgtgggatgctggtactgtgtgaggtggctttacccactacagaggttcagcccatcctatccacagtggtgagaccataatgccacttcccaccatgtcctccctcctgtgcgggccagccacaccagtcgaatggaacctaagggagggagagggaccgaaaatagggacaggagatcgcagagaatggagccaagacaacaaggctgatcaaggctcgtttattcctatgtctcattggtatttatacataaccagcacaaagaagcacaaaagataacaacatatgtaagcaacttatcggggctctggtaacgcagatacttttaacagagcattcttgattaacattgtccttcaggatgggagcatgtgactttcttatcccaagaactccacaagccaagactggccttgatttgtccaaaggctgcctgcacctccttctaccaccccgccacttctcttctgtttcgtttaagttctacactgacatactttcactctataatcaccagcttcaccctccactagacatagaattcaacacggagtagcagcaaaaccactgttcctcaagagtctagtcaaggtgtgagtctcttcctcccattccctctgtcactaccagacctgaggagcactgccgccccctggggttataggtggaatcgcttcagttttcttttcttttcttttctcttctcttctcttctcttctcttctcttctcttctcttctcttcttttattttctttttgaatttctttggttttaatttttttaacttttatttaatgaatataaatttccaaagtacagaatatggattacaatggcttccccccataacgtccctccaacctgcaaccctccccttatccactccctctccccttccattcacatcaagattcattttcaattctctttatatacagaagatcagtttagtatacattaagtaaagatttcaacagtttgctcccacacagaaacaaagtgaaaaatactgtttgagtactagttatagcattaaatctcaatgtacagcacactaaggacaaagatcctacatgaggagtaagtgcacagtgactcctgttgttgacttaacaaattgacactcttgtttatggcatcagtaatcaccctaggctcttgtcatgagctgccaaggctttggaagccccctgagttcactgactctgatcatatttagacaaggccatggtcaaagtggaagttctctcctcccttcagagaaaggtacctcctcctttgatgacccgttctttccactgggatctcactcgtggagatctttcatttaggtcccccccccccccccccgagtgtcttggctttccatgcctgaaatactctcatgggcatttcagctggatccgcaggccttaaggactgattatgaggccagagtgctgttaggacatttgccattctatgggtctgctgtgtatctcacttcccatgttggatcattctctccctttttgattctatcagctagtatttgcagacactattcttgtttatgtgatccctttggttcttagtcctatcattacgatcaattgtgaacagaaattgatcactgggactagtgagatggcattggtatatgctgaagagttaaaattgtatatgtgcgggtgtaaaaagttaagcttaagcttacaggtttaaaccttcctggtacagctgtaaaaaaataagacagagtagcaccttggcagtagggactccattttggagcacttgagactgcattctgggaaagcacccccccccccccccactgtgagactctggtctgaaactatgatctcaaatagtcggacaatagcagtgcactacatcacccttggcaatgcacaaaaaccccctagcatgactgctcaagcttaaaagtagaaaggttgcacctgggttacctgggctaataataaagatgtgatttgtctgtgtcttacattaatgtcaagtcctaattgctaattgtaagattgtaactggtattgtcaagattatgataaatattaatttcacttaggttttaggttatgttgaccccagtaaccatatactctcttttgattttatgtactctcttttgattttagcaactgtgtatagcaaccgtgcatagcaaccatgtattcccccccttcccggttttgcggtttttgcctttataaaccctaacctttggttattcggggctgctctgttcatgtatgatcaggcagccccagcatgctggataatcaataaatctttaaccctttgctggttgcatgagagaaaagtctcttggagtcgttcctcgggcggtgggctttttcagactctaacattggaggtcccaccgagatctgactgctgcctgtggacgtctccaatggatatctctcggggtaagtgcaggcgcctatttgtgttgtcggccggcttatttgtggtttgtgtctcttcattctggattttggtagtttgtgagcgctctagggttttgggaactgtgctggtgtagtagctgctgggacagggagtgagcccttcctggctgtggccggcagacgtgcccgggggccacaggctacggccctgagggatgcctcaggaggacaaaggaaggctggggacgcccagatacttccgacggggcaggcgtggagtctgcattcccagcacagacacagacggggtggccggtaaggccttcttattattagtcttttgtagttgtaaggtgctttgttggttgtcttgttgtttgttgattgtattctcttgtcatttagcattgtatggggtgctgtgatggctcccgtattggtagatttggaatctgcatttgtattgccagcattgtcgcgtgactctgaagtggttctggagtctgcatttgtaggttctgaagtggttccggagcttgcatttgtattaccggcatcctcacagggctctgaggcggttccagagtctgtgtttgtattgccggcatcgacgcgaccagtagtttatctcagttcctctacggacactttgtgtggtcattgtgtgctgattctctacactgtttgtctgttcgtgtacattgtgatgtctgctaacatgggccagactgtgtctacacctttgtctctaactttgaatcattggtaggaggtaagcgaccagacaccggacgcataacctttctttgtcagtcaagaaggtaaagtggcagtctttctgtgcctctgagtggccagctctcggagtggattggccccccagagggctcattccatttaccactcattcactgagtgaaagaggccgttctcctgcctggctgtcatgggcacccagaccgggattttgagaaaacatcggaggtccctcaagcgggaccggatctgtggaagtgaccgctgagtgtccggcaccccacagctctccgagaacgcggagttccccccggccatggcttagctatggccgaaactccagagggattgtaaggaacgggagggaaattaggaagggcagttgactgagagcctccagatcccctgagctcacttcggcttcccggcagccggactgtgacccgagcaccaggtctctctcttggagggacgcctggtcacgctgcctactgctatgcgagtagggcttagcttcggtcgaggctaatattggcccttcaggtaaactcagacaactaggtagtgggtaaccttgagtgaatgccacctcgatgggattgaattcgaatcccctggtatgtttctaactccaccgtttgaggcaagtcagcgtgagcatgtcccgaattgcacatctcttccctctcttattcccactcttatatttaacagcgatcacttttcagttaagtttcagcacttaagaagaattgtgtattgattatagtattcaaccaaatcgcttcagttttctattcctgatcgaacagttcttcattcaatgcaaaaccaactagaacattctcatcaaattgaacaatagtggcttcatcattagcacacagtggcacacaaataacagtatcacaacctcctaggcgtaggattactgtaaaaatttggacagagcccttcatctcatagagcttacatgttagtgggcagggagataatgcacacacatagaaggttctgcacctgctcccactgtgccgtgtgtgagattcctccctggggcactgccattgctcggtacaagtaggcagagtgtgtccaggtccacttagtgcatcctcccgtctcaggggcagaggcagagggaacgtatcaggcagttcaacatttgtgtttcctgaaaaattaaataactgtagtctcagtaagggtcagacaggaaaactgaattttaattcaggaaaaagctttttaaatttcttaaatcactgaagcctgaaaccaggagcacacgggccagtggaagaattagtgcccagacactggagataaaaaagaggaacccagtttagcaaggtgtcttgtactgagattaatctttatttctagtgaagataattttcttacatgttcatcctttccatttcccatcacatttatgtatttacttgaaaatctgagcattgatgaggtgcaaagtgagagagactctgtgtttggtgagagagagagagagagagagagagagagaatcttcctacttcctaggagatcctgtcagctgaggctgagtcgggctgaagaaaagagcacagaactccagatgactcccagtgtgtggcaggacccacgcatagcgacttctagaaaaatcatagccctcgccatgtttcgattcatggctcttttatgtcacaccaaggccattagggaaatagagaaaacagaagccgccctggcctcagtgacgtccgcccgaaccacactgaggagctgctcagcttctccaggttctgggctgtgcaagccctgcagcccctgtcacaggtggagcagcagcagcaaagctgggctgagccgtgaggagagcgtggacctctacccacactggtcctctctctgctgagaccccagagagacattctctgtaggagacctgtgcaacctgggtctgctgtggacacctggggacatggcacctgtgtgcaggtgctgaggggttgtagagaattctgctaactgatttgtgcatctcagcaagcaggatggtttacccaaactcgaatggtgagcaggtgctggttgcatattctaagaagttagcacatactccccagaataaaggactttctcctccaatatctgctccagatttaggagcaggctgctcccgccccatgcaggaggcagtgccaggcaggacccagcatggacacgagggcccccactcagctgctggggctcctgctgctctggctcccaggtaaggaaggccagcagcaggaacggcctcgggcagtgtggccagggctgcccgtctctgcaggagcgtcctcttagaacgtgaggatgagtgtggtctctgtgtttctgtttcctcctcagg

SEQ ID NO: 123 - DNA, 10326 bp, Oryctolagus cuniculus
ccacagtgatacaagccctaacacaaaccccccaggaaagcagaagtgtgaggctgggctgccccagctgcccctcctgggccccatctgctgagagtgattctcagagcagccaggcttgaaggtcctgcagggtcgggtggaaggggccaggctgactcctctgaggctccctccttttctcctcttggcagcatcagcacagtcatggtcatgaaatactattttaaggagagcaattattttactggagacttgagtgtatagcatcattttggtatcgcatgtaaaggagaaaatattataggtatggctagcaaaaatagtttaaatcaaggtgagtgcagtcttgcatgccctccatgtcctgggagaacggccttcagagagggagatcatagacacagagactctcagatctctcctagaggccaagcacctctggggcagaaggcacaggtgctgccccgtgtgtcctcagccctgtcctggaagccctgagatgggggcgctggtgctctcactgcctgcagcactcacaggggattcttccccgcccctctgttcccagctctgcctgcaggagctgattgacaggtgggaattctgcttgtctcatagtgaaatctcagagtctggatggcttctctagagtgcaaaggtgaccaattatgtggacctgatccaacccaattctgtgcatctttctgtattttccttccatgaagaaatgttccctctatagaggaggtcctggcttacacagcaggaccagaggcacaaccaggatggtgtgagatgccccgttcactgctcccctgcttcagtccatgttggctcacacctgtcatgcagccccttctgcagtttggccaccaaacacagttctctcacaagcagttcacaccccagatgacattgtttcagattctgggaaggtaagagaagtcgtgtttcctccccttcctcatctcctctgtcccttctcatcctgggtcagtgctgcccctcacggtcaccgtgttctaatccctgcccccggtatggaaacagatacacagatcctaagctcttcttccactcaggttcctgcttgggagccccctgccgtcacataccgagactgaagagagatcatccaagtgtttcacccagcagagttgtatctaagaggaatgctgtgccaactcccctcacaataaactgctgtttgtctcttgtcaagacacccaatgggagcaaagtgaacactttgggatgtcagagcaggatcagggaggaggtgaaaggcgttatctttcctggtgtttgcttggtgaattgttgctgtaatgaattattccattctctttggctcagacatctccaggtatgttgtgtggtcaggagctcaggtctccctggaggtaaccctggaggcagcatggctgtggtgttctggaagctctgagcatgcgattccatttatcccctttttaaaaggtataaacaccaaaaaaatcagcgttacataaggatggaaaaggagaaaatatgcttgctgtagctttgtcttcccatttaagttacccagttgtgaagtcttatttgaattcaccacagaccatttttttagctcaattatttcatttagtctaagagcacacatgttgaccagaggccttttccaagcacattttaggcacagaaatgcagagaaaacctccttcaatcatactgtatggagttctcaccacatagactctgttagatttgcataatgtaggctgtttctttgtaattgtgtattgcatatgacctctttttttatttgacagttaaacccatctttaaaaacaagtcaaagtcaggaaaaaaaaaagtataagtgcttgaagactcctgagatgttgaatgtggaggcagctccagactctgactggggtcaccactccttgagctcttctctaggtgacagctccagagaagcagcctgcgggtgttcctaacgcttcgtgcactgacctctaagtctagagtaagccccagtgagacatggaaatgcatatagaactgttagctcttccatggatttattaatcaagttacatgagtttacttactttaacaaaggcaaagtatccattatttgtccattttatttaaaaagattcatttatttatttgaaaattaagagtcacagagaggcagaggtagagaaagcgtgagagcggtcttccatctgccggttactccccgatggctgcgactgggggatctgccccatccaaagcctggatccaggagcttcttcctggtctcccacaagggtgcagggccccaaggacttgggccatcttccactgctttcccaggccatagagagagataaatcggaagaggagcagctgggtctagaaacggaacccatatgggatgccagcaatgcaggcaacgtcttaacccaccacaccacagtgccggtccatatcttcattttttaagagatttatttgtttattttaaggtcagtgttacacacacatgcaaacacacaaacacaaaaacacatacacacggggtgggagaatcttccatctgctgttatactctgcaaatgcctgcaacggccaagactatatcaggccaaggctaagagccagaacttctttcaggtctcccatgggtgccagggcccaaacacttgggacatcttcagctgatttcccaggcagttagtatggagctggattggaagtggagaagccaggaccccaacgggtgcacatatgggatgctggcagtgcaggggtggctttgaccactacaccacagtgctgcctgttatatacacattttgagaattcatgatactttgagccatactctccttccttcctcactcccaccctactgctcttctttttttgtttttttttttaatattttcaatttagtttgatgacatactttcaatgtactttttaaatactagctaagccttccactaaacaaagaattcagcgaggagtgagcagaaaaaccactgttcctccagagtctagacaaggctgagtctctcagtcctcccaaccctctgtcactagcagacctgaggagcactggcgcccctgggggtccatgatggaatggcatcagctttcaatccctgatagggcagtttttcgttcaatgcaaaatcagctagacaattctcatggaaatgaaacaatagtggcttcattgtttgtacaccatgttacaaaactgacagtatcacaatcttttctagatttagaaaaaaggacaataaatccaacagagctctttaacccatagatcttttttcagtgatcagggcaaacaagcaaacatatgttttataccttcttccactatgcttcaagtgagatcctccctggacactgccattgctgggggcacatggacagtgggtgtcctggtgcacctagtgcatcctcctgtctcgggcagaggcagagggagaggcagaggggacgaatcgggcagttccacactgtgtttcctgaaaagatacactaattgtagtctcagtaatggtcagatggccaaatagttcttcgattgagggaaaagcttcttaaatttctcaaattggtgaagcatgaaaccagccaacacagaggtcagtggaagaatcagtgcccagacactggatgtgaaaataatggagcccacggcactgtggcacagcaggttaaagccatggcctgaagctctggcatcccatagggtgccagttcaagtctcagctgctcctcttttgatgcagttctgctatggcctaggatagcaatagaagatggcccaagtctctgggcccctgcaccaagtgtgagacccagaaaatctcccggcttctggtttcggatccacgcagcaccggcttttgccgccatttagggagtgaaccagcagatggaagacctctctctctgtctctacctctctctgtaactctttcaaataaatgaaataaatctttaaaaaaaaaaaaagagcccagctttagcagggtgttttgtactgtggtgaatacttatttctaataaatataatttagataattttcataaatgttaacattttccatgtttcaaaatattttttattcacttgtaagtctgagcattggagagaggcaaagaccgggcgggggttctgtaagtggtctctccacaaatggctgtaacagtgagttcctggccaagcagagtccagagccagaactgccccggtctcccctggggggcaggaatccaagaacttgggccatttcctgctgcctcccagggtgagcattagcaggaaatgggatcagaagtggagcagtggggattcaacccagtctctgatgtaggctgctggcattgcaagtggcagccttacccactgtgccctgatgccggccttccctcctctccggatttctttctttctttctttctagacaaatttacagtgagaggcagagaaagagagaggtctcccatcctctggttcactctccaagtggctgcaatcctcagagctgtgctgatctgaagccaggagccaggagcttttctggatctcccaatgggtgtaggggcccaaggacttgggccatcttctacctctatccccggccatagaggagcgctggatcagaagaggagcaggcgggactagaagcagtgcctatatgggaagccagcgcatcaggcaagcacattaacactctgccatagcacagcccccctctctggatttcttaagaaggtgtggacatttctggacaggggagggaggaagtgtttctcagacctctggtgactccttgaagctcgcacttctggcttcctcctgtatccttgactcagaactctggctgcagatgggagagcacatctgtgtgatctctcctctaagcacctgcgttctccttctgagtcctggtctctggcagccgcttgttctgaggatgtttattctgagtcagtacagaggtgagtgtgggcagaagtctcgtctctcagagaccatctctctggtgcagcggtctgccgtgaggggacgatgtgagggcatcagaggagcaacaggtaaagacatggacctcagctttaaggtgtaactaagtattccctagaaaatggactttcttctaaagaaaccattaaatgtcatctgaggatgggagtgaggcaggacggggcacatggtggactatctggatgcttttaaaacatacacacgacaggccagccgtggataaagtgccgtggataaagccatccctgcctgctgcctcactcccatcctcagtgctcttctttttaaaattttaatttaattttattttaaaaggctttatttgtttatttgaaattcagagttacacagagagagtagaggcagagagagagaggtcttccatttgatggttcactccccagttggccacaatggctggagctgtgccaattcaaagccaggagccaggagcttcttccatttctcccacctgagtgcagggccccaaggacttgggccatcttctactgctttcgcaggccatagcagggagctggaacagaggtggtacagccgggactcgaaccattacccacatgggaggccggcgcatcaggccagggcattaacccgctgcgccacagcgctggcccctattttaacttttgaaatgacatactttctttttttttacatttattatttaattttatttatttttctctgttctggaaatgaaagatacagatactgaataacgtgcaaaattgtattttcaaacctaaaatatagttgatttccatcctcccaaccccaaaccccattgtcagcttgctttgtgtttactctcacagtttcgtgtttgttgctattaaggcagccttctcctttgtcttttcaaaaaaaaaaaaaaaacttcataatttagatatatagatcaagcaggaaccatcaggatcatcccttaggcgtcaaatggggaaattgtgatataggaaagtaaaatgattctatttagattattggagcaatattgtagagtgaaactcaagttgtaaatttattctgaaaaattttttttaaacttttatttaatgaatatagatttccaaagtacagcttatggactacactggctcccccccccccccccgatgacttccctcccacctgcaaccctcccctttcccgctctctctccccttccattcatatcacgattcattttcaattttctatatatacagaagatcagtttagtatacattaagtaaagatttcaacagtttgcacccacttagaaacacaaagtgaaaagtactgtttgagtactcattatagcattaaatctcaatgtacagcacattaaggacagagatcctacatgaggagtaagtgcacagtgactcctgttgttgactttacaaattgacactcctgtttatggcatcagtaatctccctatgctccagtcatgagtttccaaggttatggaagccttttgtattctccgactcttatcttatttagacaaggtcatagtcaaagtggaggttctctcctcccttcagagaaaggtacctccttctttgaagacctgttctttccactgggatctcactcatagagatcttccatttaggtcctttttttttcttttttctttttctttttcttttttttttttttgccagagtgtcttggctttccatgcctgaaatattctcatgggcttttcagccagatccgaatgcctttagggctgattctgaggccagagtgctgtttaggacatctgccattctatgagtctgctgtgtatctcgcttcccatgttggattgctctcccctttatttattctatcggttagtattagcaggcactagacttgtttatgtgatccctttgactcttagtcctttcattatgatcaattgtgaactgaaatagatcacctggactagtgagatggcactggtacatgccaccttgatgggattgaattggaatcccctggtatatttctaactctaccatttggggcaagtcagcttgagcatgtcctaaattgtacatctcttccctctcttattcccactcttatatttaacagggatcacatttcagtttaattttaacacttgaccagcgccgcagctcactaggctaatcctccaccttgcagcgctggcacaccgggttctagtcccagtcggggcgccggattctgtcccggttgcccctcttccaggccagctctctgctgtggcccgggagtgcagtggaggatggcccaagtccttgggccctgcaccccatgggagaccaggagaagtacctggcttctaccatcggatcagcgtggtgcgccggctgtagcatgctggccgcggcggccattggagggtgaacccacagaaaaggaagacctttctctctgtctctctctctcactgtccactctgcctgtcaaaaaaattaacaacaacaaaaaaaaaaacccacaaaaacaattttaacacttaagaataactgtgtattaattacagaattaaaccagtagtattaagtagaacagacaaaaaaaaagaaactaagagggataatgtattaagttgttcattaacagtcagggctatgctgatcaagtcaccatttctcatagtgtccttttcatttcaacaggtttcctttttggtgttcagtcagttgtcaccgatcagggagaacatatgatatttatccctttgggactggcttatttcactcagcatgatgtgttccagattcctccattttgttgcaaatgactggatttcattgttttttactgcggtatagtattctaaagagtacatatcccataatttctttatccagtctaccgttgatgggcatttaggttggttccgggtcttggctattgtgaattgtgctgcaataaacattagggtgcagaccgcttttttgtttgccaatttaaattcctttgggtaaattccaaggagtgggatggctgggtcgaacggtagggttatcttcaggtttctgaggaatctccagactgacttccatagtggcttgaccagtttgcattcccaccaacagtgggttagtgtcccttttcccccacatcctcaccagcgtctattgttggtagatttctgtatgtgacccattctaaccggggtgaggtgaaacctcattgtggttttgatttgcatttccctgattgctagtgatcttgaatattttttcatgtgcctgttggccatttggatttcctcttttgaaaaatgtctattgaggtccttgacccatctcttaagtgggttgtttgttttgtttttgtggggtttcttgatcgaaatgacatactttcaatgtagttaataaacactagctcagccctccatatatacagaattcaacacggagtaagcagaaaaccactgttcctcatcctaaagacaaggctgtgagtctcaatcccctcaatccctctgtcactaccagacctgaagtacacttgtgccccctgggggtctcaggtggaatcatgtcagctttcaatccctgatagagcagttcttcatttaacctgaaatcaaatagagaattctcatggaattgaaccaatagtaacttcattgtttgcacgcaatggcacacaactaatggattcacatctcttgtagatgtagactaagtggaaacatcgaacagagcccttcatctcacagatcttccatggtagtgggcagggctgatgatattcaaaccaataatgttctacctctgctcctgatattggaatttgaccttccaaaaatataatttggggtgccatacgatatcaccatatgcttattaataagttccccatattaataagcccatgtgggttcttgtctaatattcagagaattgtgaatactggcataagtgaacaaggcagcatggtacattttaagttttatacagtgagaaagatgcataggagagtaagggccctgtctaaaggtgagaggtagatctgggttcataccaagtaccaggaaccagccacgtggaggagcatctaggccaggaagcgtggggtgggtagcggaggcacagggctgcagccagccccctactggcaaaaaagccagggaaagaagggagggaaagagggcagacacaccatgtcccaggcttttaatccacttccaagaggagtggttaattcacctgattggctggtgcccactcaggtgtggccagcagtggagcagtggggaatcaaagcagtctctgatgtaggctgctggctttgcaagtggcagctaatccactgtgccacgatgccagccttccctcctctctggattttcttaagacaaacgtgaacgtttctgaataggggagagagggaagttatttttcttgatgttcctgagacctatgatgaagccttgaactttcacttcttttttcgttatgcaacctgatcagaactcaggctgcagaaaggagagcagctgtgtgatctctcctctaagcacctgtgttctccttctgagtcctggtctctggcagccgcttgttctgaggatgtttattctgatcagtttcagaggtgagtgtggacagaagtctcgtctctcagagaccatctccctggtgcagtggtctgccgtgaggggacaatgtgagggcatcagaacacaagtaaagaaatggccttaggcataaattagtttactatctattttaaagaaaaggaactttctcctacagatcccaaataaccatgaatttattacaccatcttgtccaataaactcacaattttggtaagtgtccctcagtgactttgggaagtgatgtctcccagtagaaacatgtgcactgtaggtaaacttgtgcagccctggtcagagctggggcagtggagacacagcccctgggctgagctctgagctgccctgggcccttcagctgggcacagccctgccccatccctgctcatttgcatgtccccagagcaccgcccacctctctgggcatttaggagcaggctgctcccaccccatgcaggaggcagtgccaggcaggacccagcatggacacgagggcccccactcagctgctggggctcctgctgctctggctcccaggtaaggaaggccagcagcaggaacggcctcgggcagtgtggccagggctgcccgtctctgcaggagcgtcctcttagaacgtgaggatgagtgtggtctctgtgtttctctttcccttctcagg

SEQ ID NO: 124 - DNA, 5089 bp, Oryctolagus cuniculus
ccacagtgatacaagccctaacaaaaccccccaggaaagcagaagtgtgaggctgggctgccccagctgcccctcctgggcccatcttctgagagtgattctcagagcagccaggcttgaaggtcctgcagggtcgggtggaaggggccagggtgactcctctgaggctccctcctttccctgctccttggcagcagcagcacagatacggtcatgtctctacagttttaatggaaagcaattattatttctgagtattgaaaactggagcatcatttgaaattcatagagtaaaagagaaaatattatatattacaaggaaaaatattataaatactggtgattagaaaattttataaaggatttcaatatcatatataaatattttaaaatatttatttgcttatgattcgccatacactcacacacacacacacacacaaacacacagtgacagggagagaggttctcttccatctgctgggatggcatacagtgtgatgatgctgcctcttactactgtcaaagcaattattatattagtagtgctggtaccacagtgttccaagccctaacaaaaccccccaggaaagcagaagtgtgaggctgggctgccccagctgctcctcctgggccccatctgctgagagtgattctcggagcagccaggctggaggtccctacaggttttgttggaaggggccagggtgactcctctgaggcttcctcctttccctctccttgttggcagccacagagacacagtcaggtccctgctattttaaggagagcagttattctgtcaggtaggaagtcagatatgagcttgtgtgtgtgtgacaaaggcctaaagagaagacatctatgtccggcatgtgcatctcaaagtcatccctataatgtttcagcccagtgttcgcatcctgccctgcccccttctccctgataatctatcaggtgggggttcccaccccttctgcctgacaatcttccaggtgcagcccagtatctgaacttcaaaagccctacctgcccttcctctaacgggggaggtgccagctagacttcgccctgtctgacaacttcagggagaaaactcagataggagtttttctatttacatccataaagtgttttgtttcaggaggagatgtgtgaagacaaagacccatctccttaaaaacccccggtctcaaaaggactgtgccctcagtcctctgtctctctgctgagccgcccgcctggcctggtcaggtgtactctccactcaaccatgtaaccctctggtcatccacagctgccctctgggttttctctgcacaaacccatatcggagaacgaggccccgcacactggtgattctctcttgtaccattctgtaggtcttaattgcttttaaaaatgtatataaatgcaaccaatttggagcccgcagcaaggaaaatggtggacgggaaggcgggagagagaagcccatagggccgcagtgagctggagccccaggtaatggaggggaaacaaccaggattagtgctgaaaaccatcatctgagaggaagctgagccttcccaacaaaacctacaaagatctgcaggtctgcattggccacaggtgggcagacgtccaagacagcatcagccacatgcgccagctgggtcaataagctgcagagactgctccacctctggctgcaaacgccctctcaggagcagggcttgtaatggagatgaagatggggaacctgagcagaggcctccaggagccaaggtgaggatgaggagcactggaaggattcgccagcatcagccgacacatccctgcaggagggaaagcacgggttttctgaggagcagaggctctgggagccagatatcaaacctcatcctggaaatggccgtgaccaagacaactgaatgacgcgttttgaaattggggatgggtgtggggtgggtgttaagttgaaaggaacaggttccctttttgaagaatggtataaggcagtctctgaagctgctttgttttcttctttttcatattctttaaggatgagtggtagtctaataaatgagaatttgaaattgaaggacagttgtattgtatatacagctttcagacatttgttgattttgtagctttgtttgatcagtttccaaaggctacagataataaagaaatcagaagtggcaccagttaaggaatagcgtatttttagacacaactactagcacatcaagggggaagcacaactttactgtcttatctctctgaactccctccttccctgaactggcagcctcccaggagcagccttatacagagaaggggtattgtactgagaaaaagggactgactattgactgagagtaaattgggatgaactaagctcagcctttttcttcctgggcatttgttggatttgaagtcaccataaactcggtgttgcattgctgtcagcgggtaccacggcttagctcttttttaaaaaattaactttgtacgtaaactatcgagtattagaaatagcctacttcaccttaaggggtcttgtctgccttcattagttgtccaaggccaaccgtttgctaccaaagtgaatcagtattttgaaggtgcttctcttggtatttggttgttagatagtttctgtatgcgtttcccccagactgaggcaaatcagaaagaagctgtttcttttaaaatacaaatcaccaagaatgtaaattcaaagaacatctcttaaaattgattaatgcatacagtggtgggaatggacctagtaaaggtggttggatggccttggggttgataccttataaaatgattggataaagtatagggaccaagccactagggtgtacatgtcaaactgcagggtttctggatgtaatcaatcaccttaactgcctgaagacacctggaacttcaggtagttccctgctatgtcctaattggctgtgcttggggaggttattccaaggagagtttatttttcttctttcaggagcttttggcttggggttcagggcctggtcaggcctgagttacaaggtgaaatctagtctaaaatagctctgcttgatccaggcacaggtctctcaggccatcttccactgctttcccaggccctagcagacaggtggatcggaagtggaatagctgggtcttgaaccggcacccatatggaatgccagcactgagggcagtggctctactcgctatgccacagcgctggccccacactgaaatattctcaatgtactctataaacactagctcagccctccactctataaagaattcaacacagagtagcagaaacaccactgttcctcaagagtctagacaaggctgagtctcaatcctcccaggccctctgtcactaccagacctgaggtgcactggcaccccctgagtgggtcgcaggtggaattgtgtcagttttcaatctctgatggagtagttcttcatttaatccaaaatcaaatagaacattctcatccaattgcaccaataggagcttcattgttggtacataaaggcacacaatgaagagtatcacaaattcttaagcctggaataattggaacaagtcgaatagagccctttatgtcatagatctttcactttagtgggctgagcggataagaaacaaaccaatgatgttccaactgtgctcccactgtgctctgtgatgcacctcccatggagcagggccagtgctcaggacaatggggctgtgggtgtgcaggtgcatgtgtgcctccttctctctccacctagacaggggcagtggcagaggcagaggagagggaatggatcgggcaactccacatctgtgtttcctgaaaaataaactcattgtactctcggtgatggtcgggtagccaaactgtcctgacaaaagcttttaaatattctcctgtccctgtagcatgaggtcagccaacacacaggtcagaggcaatcagtgcccagacactggaaacaaaaaaatggagcccagttttagcaggggtgacttctactgaggataatacttatttctgtgaagataatattctcaaatgctaacattttccatttttcaaaatatttatttatgtatttacttgaaagattgagtattggagagaggcaacacagaatgattgagagggcaaaggagaaagagagagagagagagagagagagagagagaaagagagaaatgttatgtaatctggtctctccacaatggctgtaacagtgagttcctggccaagcaaaatcccaggaccagaactgcccctgggtctcccctgtggggcaggaatccaaggacttgggccattttctgctgcctcccagggtgtgtgttagcaggaaatgggatcagaagtgagcagtggggattcaaaccagtctctgatgtaggctgttggcattgcaagtggaagccttatccactgtgccacaatgccagccttccctccgctcctgatttcttttttatttatttatttatttgaatgacaagtaacagacatggccctaggcttaaatatgttaactatctcgagaaaagggactttctcttccagaatcccaacataaccatgaataaatgacgacaaattgtcttgcagctcacttaaagttttagcaagtgtccctcagtgactttgggaggtggcgtctcctggtagaagcatgctctctgcaggtaaacttgtgcagccctggtctgagctggggcagtggagacacagcccctgggctgagttctgagctgccctgggcccttcagctgggcacagccctgccccgcccctgctcatttgcatgtccccagagcaccgcccacctctctgggcatttaggagcaggctgctcccgccccatgcaggaggcagtgccaggcaggacccagcatggacacgagggcccccactcagctgctggggctcctgctgctctggctcccaggtaaggaaggccagcagcaggaacggcttcgggcagtgtggccaggactgcccgtcactgcaggagtgtcctcttagaacgtgaggatgagtgtggtcgtggtgtttctgtttccctcctcagg

SEQ ID NO: 125 - DNA, 2895 bp, Oryctolagus cuniculus
ccacagtgatacaagccctaacacaatccccccaggaaagcagaagtgtgaggctgggctgccccagctgctcctcctgggccccatctactgagagtgattctcagagcagccaggcttgaaggtcctgcagggtcgggtggaaggggccaggtgactcctctgaggctccctccttcctcctccttggcggcagctgcacagacatgaccatgtccctactgttctaaaggaaagcaactattctctgagtactcaaagatagagcatcatttgagattcatagagcaaatgagaaaatattagatattacaaggaaaatattttaaatacaggtgattataaaattttataaaggatacaaatttacaaatttcatatatacagtttttaaaaagatttatttgcttattgaaagcacaagctttagacacacacacacacacacacacacactgtttcagagagagagagttctcttccatctgctggttcactcctccaatggctgcaatgggacatgcaacttctttcaggtctcctacatgggtgccagggctgaaacacttgttccatctgctggtgctttctcaagccattagcagggatctggattagaagtggagcagccaggactcccactggtgcccatgtgggatgatggtgctgaatggggcggctttacccactgcacaaggctggcccattgtatccacagttgtgagagcataatgccacttcctaccatgtcctccctccttcctcactcccacccactcctcttctgtttcttcttctcattggatttttacactgacacactttcactttataatcaccagcttcaccctccactaaacaaagaattcaacacggagtagcagaaaaaccactgttcctcaagagtctagacaaggctgggcgtctcttcctcccagtccctctgtcactaccagacctgaggtgcaccggcttcccctgggggtcccaggtgaaatcacgtcagctttccatccctgatggagcagttcttcactcaatacaaaatcaatagaaaattctcatcgaattgcaccactagcagcctccttgtttgtacccatctgtacacaaataacagtagcacaaccttaggcatagaatgattgggacaagtcaggcagggcagataataaaccaatgacgttctacctctgctccctctcggctccacggtagaggcctcccctgggcagcacgattgctcaggacaaggggcctgtgggtgtccaggtgcatttgtgcatcctcagtctcagcctagacagggactgaggcagagaaacgaatcagtcagttctacacttgtgtttccaggaaaaagctaaggtgtggtctcagtaatggtcacagagccaaagcatcctatgattgctgaaaaagtttttaaatgttcacattcctgtagcatgaaaccaggcaacacacaggtcggtggcgagaatcagtgccctgacactggagatagcaacaaatggagcccagttttgagagggtgtcttgcactgtggttaacatattatttctaatgatgttaattttcttcatgttaccattttctgtttttcaaaaaatttatttacctgaaacctaggcattgaagagaggcaaagagagattgatagggagagagagagagaaagagagagagatcttctgtaacctgtgctctccaaaaatggctgtaacagtgagttcctggccatgcagaagcccagagccagaactgcccctgggtctaccatgtcgggcaggaatccaagaacttgggccattttctgcggcctcccagggtgtgtgttagcaggaaatgggatcagaagtggagcagtggggattcaaaccagtctctgatgtaggctgatgctggctttgcaagtggcagccttatgcactgtcccacaatgccagccttaactcctctcaggctattcctaagaaaagtatgaacatttcaggacaggggagagagggaagttatttttctttgagttcctcagacctgtggtgactccttgaaacttgacttctcttttcctcttgcatccttgactcagaactctggctgcagatgggagagcacacatgtgtgtgatctctcatctaagcacctgcgttctccttctgagtcctggtctctctttggcagtagcttgttctgaggatgtttactctgagtcagtacagaggtgagtgtggacagaagtctcgtctctcagagacaatctctctggtgcagcggtctgccgtgaggggacaatgtgagggcatcagaggacaagcaggtaaatacatggacctcagccttaaggtgttaactattttctagaaaaataactttctcctccagaatcccaacagaatcataaaaaatgataacaaattgtctgcgagttcacttaaagttttacaaatgtccctcagtgactttgggatgtgacatctcctggtagaaatatgtgctctgcaggtaaatgtgtgcagccctggtctgagctgggacagtggagacacagcccctgggctgagttctgagctgtcctgggcccttcagctggcacggccctgccccgcccctgcggatttgcatgtccccagagcaccgcccacctctctgggcatttaggcccaggctgctcccgccccatgcaggaggcagtgccaggcaggacccagcatggacacgagggcccccactcagctgctggggctcctgctgctctggctcccaggtaaggaaggccagcagcaggaacggcctcgggcagtgtggccagggctgcctgtctctgcaggagcgtcctcttagaacgtgaggatgagtgtggtctctgtgtttctgtttccctcctcagg

SEQ ID NO: 126 - DNA, 6048 bp, Oryctolagus cuniculus
ccacactgttccaagccctaacaaaaacccccaggaaagcagaagtgtgagactgggctgccccagctgctcctcctgggccccatctgctgagagtgattctcagagcagtcaggcttgaaggtcctgcagggtcgggtggaaggggccaggctgactcctctgaggctccctcatttcctccttcttggcagcatcagcacagtcatggtcatgaatattttaaggagagcagttattttactggagtctttgagtgtatagcatcattttggggccagcgtcgcagctcactaggctaatcctctgccttgagacgctggcacactgggttctagtccaggtcggggcgccggattctgtcccggttgcccctcttccaggccagctctctgctgtgaccagggagtgcagtggaggatggcctaagtgcttgggccctgcaccccatgggagaccaggagaagtacctggctcctgccttcggatcagcacggtgtgtcggccgcagcgcaccgtctgcggtggccattggagggtgaaccaacagcaaaacgaagacctttctctctctctctctctctctctctctgtctctgtctactctgcctgtaaaaaaaaaaaagcagcatcattttggtatcatatgaaaaagagaaaatattataggtatggcaagcaaaaatagtttaaatcaaggtgagtggagtgttcgcatgccctccatgtcctgggggaacagccctcagagaaggagattgtggacacagagactctcagatctctcctagaggccaagcacctctggggcagaaggcacaggtgctgccccgcgtgtcctcagccctgtcctggaagccctgagatgggggcgctggtgctctcactgcctgcagcactcacaggggattctcccccgtcccactattctacgctctgcctacaggagctgattgatagacaggaattctgcttgtctcatagtcaaatctcagagtctgggtggtttctctagagtgcaacagtgcccaattatgcggacttgatccaacccaggtctggacgtctttctgtagtttctctccaggttgcaatattccctctatagaggaggccctggcttgcacagcaggacccgaggcacaaccaggatggtgtgagatgcaccgttcactgcacccctgcttcagtccatgctgacccacacctgtcatgcagctccttctgcagtttggccaccaaacacagttctctcacaagcattgcacaccccaggtggcgtttcagattctgggaaagtaagagaagtcgtgtttcctccccttcctcatctcctctgtcccttctcatcctgaggtcagtgctgcccctcatggtcactgtgttctaatccctgcccccggtatggaaacagatacacagatcctaagctcttcttccactcaggttctgcttgggagccccctgccgtcacataccgagactgaagagagatcatccaagtgtttcacccagcagagttgtatctaagaggaatgctgtgccaactctcctcacaataaactgctgtttgcctcttgtcaagacacccaatgggagcaaagtgaacactttgggatgtcagagcaggaccagggaggaggtgaaaggcgttatcttccttggtgtttgcttggtgaattgttgctgtaatgaattattccattctcttcggctcagacatctccaggtatgttgtgtggtcaggagctcaggtctccctggaggtaaccctggaggcagcagggctgtggtgttctggaagctctgagcatgcgattccatttatcccccttttaaaaggtataaacaccaaaaaaaccagcgttacataaggatggaaaaggagaaaatatgcttgctgtaactttgtcttcccatttaagttacccagttgtgaagtcttatttgaattcaccacagaccatttttttagctcaattatttcatttagtctaagagcacacatgttgaccagaggccttttccaagcacattttaggcacagaaatgcagagaaaacctccttcaatcatactgtatggagttctcaccacatagactctgttagatttgcataatgtaggctgtttctttgtatttgtgtattgcatatgacctctttttttatttgacagctaaacccatctttaaaaacaagtcacaggcagaaaaaaaaaattataagtccttgaagactcctgagatgttgaatgtggaggcagctccagactctgactggggtcaccacacttgagctcttctctaggtgacagctgcagagaagcagcctgcgggtattcctaacgcttcctgcacttacctctaagtctagagtaagccccagtgagacatggaaatgcatatagaactgttagctcttacatggatttattctttgtttattaattctttgtttagtggaaggctgagctagtgtttttaaagtacatcgaaagtatgtcgcaaaacttaattcaaaaaatttaaaaaaaaagagcagtagggtgggagtgaggaaggaaggagagcatggtgcaaagtatcatgaattctcaaaatgtgtatatgacaggcagcactgtggtgtagtggataaagccacccctgcactgccagcatcccatatgtgcacccgttggggtcctggctttattaatggatttattaatcaagttacatgagtttacttactttaacagaggcaaagtatccattatttgtccattttatttaaaaagattcatttatttatttgaaagttaagagtcacagagaggcagagttagagagagcatgagagaggtcttccatctgctggttcactccccgatggttgcgactgggggatctgccccatccaaagcctggatccaggagcttcttcctggtctcccacaagggtgcagggccccaaggacttgggacatcttcagctgatttcccaggctgttagtatggagctggattggaagtggagaagccaggaccccaacgggtgcacatatgggatgctggcagtgcaggggtggctttatccactacaccacagtgctgcctgtcatatacacattttgagaattcatgatactttgcaccatgctctccttccttcctcactcccaccctactgctctttttttttaaattttttgaattaagttttgcgacatactttcgatgtactttaaaaacactagctcagccttccactaaacaaagaattcaacgaggagtgagcagaaaaaccactgttcctgcagagtctagacaaggctgagagcctcagtcctcccaagccctctgtcactagcagacctgaggtgcactggcgcccctggtggttccatgatggaatggcatcagctttcaatccctgatagggcagtttttcgttcaatgcaaaatcagctagacaattctcatggaaatgaaacaatagtggcttcattgtttgtacaccatgttacaaaactgacagtatcacaatcttttctagatttagaaaaaaggacaataaatccaacagagctctttaacccatagatcttttttcagtgatcagggcaaacaagcaaacatatgttttataccttcttccactatgcttcaagtgagatcctccctggacactgccattgctgggggcacatggacagtgggtgtcctggtgcacctagtgcatcctcctgtctcaggcagaagcagaggtaggggcagagggaatgaactgggcagttccacactgtgtttcctgaaaagatacactaattgtagtctcagtaatggtcagatggccaaatagttcttcgattgagggaaaagcttcttaaatttctcaaattggtgaagcatgaaaccagccaacacagaggtcagtggaagaatcagtgcccagacactggatgtgaaaataatggagcccacggcactgtggcacagcaggttaaagccatggcctgaagctctggcatcccatagggtgccggttcaagtctcagctgctcctcttttgatgcagttctgctatggcctaggatagcaatagaagatggcccaagtctctgggcccctgcaccaagtgtgagacccagaaaatctcccggcttctggtttcggatccacgcagcaccggcttttgccgccatttagggagtgaaccagcagatggaagacctctctctgtctctacctttctctgtaactctttcaaataaatgaaataaatcttaaaaaaagagcccagttttagcaggttgttttgtactgtggtgaatacttatttctaataaatataatttagataatttccgtaaaagttaacattttacatttttcaaaatatttatttattcacttgcaagtctgagcattggagagaggcaatgatgcgggggtgtctgtaagtggtctctccacaaatggctgtaacagtgaggacttggccaagcagaccccagagccagaactacccctggtctcccctgtggggcaggaatccacgaacttagggcatttcctgctgcctcccagggtgtgcattagcaggaaatgggatcagaagtggagcagtaggattcaaaccagtctctgatgtaggctgctggcattgcaagtggcagccttacccactgtgccatgatgccagccttccctcctctccggatttctttctttctttcttcctttctttctttctttctttctttctttctttctttctttctttctttctctctctctctctctctctctctctctctctctctttctttctttctttctttctaaagacaaatttacagtgagaggcagagaaagagagaggtctcccatcctctggttcactctccaagtggctgcaatcctcagagctgtgctgatctgaagccaggagccaggagcttttccggatctcccaatgggtgtaatgcccaaggtcttgggccatcttctactgctatccccggccatagaggagtgctggatcagaagaggagcaggcgggactagaaacagtgcctatatgggaagccagcgcatcaggcaagtgcattaacactctgtgccaaagctccgcccccttctctggatttcttaagaaagtgtggacatttctggacaggggagggaggaagtgcttctcagacctctggtgactccttgaagctcgcacttctggcttcctcctgcatccttgactcagaactctggttgcaggtgggagagcccacatgtgtgatctctcatctaagcacctgccttctccttctgagtcctggtctctctttggcagtcgcttgttctgaggatgtttactctgagtcagtacagaggtgagtgtgggcagaagtctcatctctcagagaccatctccctggtgcagtggtctgccatgaggggacaatgtgagggcatcagaggaaaagcaagaaaagacaatgacctcagttttaaggtgtaactaagtattccctagcaaatggactttctcctgaagaatcgcaacataaccatgaatacattacaccagcaggtcgttcagttcaccaaacgtttttgcaattgtccctcagtgactttaggatgttgcgtctcctggtagaaacatgtgcacagcaggtaaacttgtgcagccctggtctgaactggggcagtggagacacagcccctgggctgagttctgagctgccctgggcccttcagctgggcacagccctgccccgcccctgctcatttgcatgtccccagggcactgcccacctctctgggcatttaggagcaggctgctcccgccccatgcaggaggcagtgccaggcaggacccagcatggacacgagggcccccactcagctgctggggctcctgctgctctggctcccaggtaaggaaggccagcagcaggaacggcttcgggcagtgtggccagggctgcctgtctctgcaggagcgtcctcttagaacgtgaggatgagtgtggtctctgtgtttctgtttccctcctcagg

SEQ ID NO: 127 - DNA, 415 bp, Oryctolagus cuniculus
ccatagtgttccaagccatttgggaggtgaaccagtggaaggaagacctttctctctctctctctctctctcaatgtctaactctatccatcaaataattttttttttacttgcaatatcttgttttctcttttgtgcagagaatcccaactgatgctccagcctaaatacttgtaaaaagtaattgcttttctctaaagcaagtagggtcatggtcgtgtcagtactacagctgcaagagggagcctcagaggagtcagcctggccccttccacccgaccctgcaggaccttcaagcatggctgctctgagaatcactctcagcagatggggcccaggacaagcagcgggggcagcccagcctcacacttctgctttcctggggggattttgttaggtcttggaacactgtggt

SEQ ID NO: 128 - DNA, 2568 bp, Oryctolagus cuniculus
ctgaggagggaaacagaaacaccacgaccacactcatcctcacgttctaagaggactctcctgcagagacgggcagccctggccacactgcccaagaccgttcctgctgctggccttccttacctgggagccagagcagcaggagccccagcagctgagtgggggccctcgtgtccatgctgggtcctgcctggcactgcctcctgcatggggcgggagcagcctgctcctaaatgcccagagaggtgggcggtgctctggggacatgcaaatgagcaggggcggggcagggctgtgcccagctgaagggcccagggcagctcagaactcagcccaggggctgtgtctccactgccccagctcagaccagggctgcacaagtttacctgcagtgcacgtgtttctactagcaaatgtcaaacccaaaagtccctgagggacatttgtcaacactttaagtgaactggaggccaagatggtgtaatgtattcatggttatgttggcatctgtaggagaaagtccatttttctggagagtgtgtggtaacatcctagaattagcaacctcacttgctcatcattcaactttgggtaaccctccctgcctgctgagatgcagtcagatagaattctatccaatccctcagcacctgcacacaggggcagtgccatcaggtatccatagcagacccaggttgcacaggtctcctacagagaatgtctctctggggtctcagcagagagaggaccagtgtgggtagaggtccacgctctcctcacggctcagcccggctttgctgctgctgctccacctgtgacaggggctgcagggcttgcacagcccagaacctttgagaagctgagcagctcctcggtgtggttctggtggacatcactgaggtgcagggaggcttcccctgtcttgtattccttaatggccttggtgtgacataaaagagccatgaattgaaaacatggcgatggctatgatttataaaaatgactgtgcttggatcctgccacacactgggagtcctacatggagtcctgtgctctggactgtggcctgaccctgcctcagctggcagggtcatccgggaaactaccagcatatggaggattctccctctctttctctttctctctctcttagtctctctcactttgcctctcaccaatgctcagtctttcaagtaaataactaaataagtattttgaaaaatgggaaatattacatttaagaaaataaatgggggtcacatgtgcaatcgtgtcatttttcaatctgtgctgcaataattcttcatttaatccaaaatcaaatagaacattctcatcgaattgcaccatagcagcttcattgttggtacataatggcacacaaggaatagtatcataatctcttatgcatggaacaattggaacaagtcgaacaaagacctgtatatcatagatctttcatttagtgggctaagaagatgagaaacaaacctatgacgttccaactgtgctcccactgtgctcggtgtgatgtgcctcccatggagcagggccagtgctcaggacaatggggctgtgggtgtgcaggtgcacgtgtgcctccttctgtctccacctagacaggggcagaggcagaggcagaggagagggaatgtatcgggcaactccacatctgtgtttcctgaaaaataaactcattgtactctcggtgatgatcgggtagacaaactgtcctgacaaaagcttttaaatattctcctgtccctgtagcatgacgtcagtgagcacacaggtcagaggcaatcagtgcccagacactggagagaaaaaaaaaatggagcccagttgaatgtacattagcaggaaataggatcagaagtggagcagtcgggattgaaaccagtctctgatgtgggctgctggcattgcacatgacagccttatccactgtgccatgatgccagtctaccctcctccctagcttttcttagaaatacagtgaaggtttcaggaagaggagagagggaagttattttcttgatgttcctcagacctatggtgacctcttgaaagtttcactcattgtttcctcttgcgtccttgactcagaactctgtctgcagatgggagagagtttattgggggaaacctcacagatgagagggtagagtgaagaaggaaaagggagtgaagagacagagagcgagacagacagagacagagatcaggagatggagagaaagagacgcgtcaggaacaggtccttttaaactttgccaggggtcagttagggaagtaggagcaagaattcccattaggatgggggtgtggctgacaccggtggttggaccatgtgaccaccttgcttccagtaatggggtaggggggaggctacagcctaggatgatgtcagggtgtagattgtgccatagactgcgtcattttgccatatagctaattttctccccttttgttttttataaagcaagagttgtatcagattacattagtcccaaaagtccaggagaggtagagggatggtgatctgtctttagagctacttcctgc

SEQ ID NO: 129 - DNA, 3801 bp, Oryctolagus cuniculus
ccacagtgtcccaagccctaacaaaacccccccaggaaagcagaagtgtgaggctggctgccccagctgctcctcctgggccccatctgctgagagtgattctcagaacagccaggcttgaaggtcctgcagggtcgggtggaaggggccagggtgactcctctgaggctccctccttcctcctccttggaagcagcagcacagacatgaccatgtccctactgttttaagcagggcaatattctttctgagtgttctaatctagagcatcatttgagattcacagagaaaagagaaacctttatagatattacaaggaaaaatattttaaatactggtaattagaaaattttataaaggataccaatttcaaacatacagtttttgttttttttttttatatacacacttttttaaaaaagatttatttgctttttgaaaccctgcgctttacacacacatgcacacacacacacagtgtgacagggtgtctttaagtttaaggtttccccatgggacgtagcctgcccgagtggttgtaggttatcttggtggtttcagagcagggactgttcctctgagggaaacaagttatagacatcagtctgctcctccagctgtaaccggcatatttctggcttctgtatgtctgcttgcttgataatggtcaaggccaccaaatgtagtttctgcctttaaacccccagcactgctactcggggctgtgttctctggacttgctctgtgacagggcagtggccagctggctaataaagactcctaatttgacttcaaaggtctcgctgtgttttcatcagtgtgctccacaacattagtgacagagagagagttctcgtccatctgctggttcactcctcaatggctgcacctgctgaggctgtgcctggcagagctgggacatggaacttctttcaggtctcctacatgggtgccagggtgctttcccagggcattaacagggagctcgtttggaagtgcagcagcaggactccaccggtgcccatgtggatgctggcgctgcatgtggcggcttcacccactgcacaaggcctgcccatggtatccacagttgtgagagcataatgccacttcctaccttgtcctcccttctgcctcactcccaaccctctcctcttctgtttcatttaagttctactctgacatactttcactttataatcaccagtttcaccctccactaaacaaagaattcaacacggagtagcagcaaaaccactgttcctcaagagtctagtcaaggtgtgagtctcttctcccaatccctctgtcactaccagacctgaggtgcactggtgtcccctggcggttagaggtggaatcgcgtctgctttcaatccctgcttgagcagttcttcattcaatccaaatcaactagaaaattatcatcttttggaacgaacaatagcttaattgtttgcacacagtagctcacaactaacagtatcacaatctcctaggcaacgactaactaaaaaatcgaacagagcccttcatctcatagatctttcattttagcgggcagggcagataagaaacaaatatcacctgctccccctctgggccatgggagaggcctcccctgcagcactgccattgctcagggcaggtgggcattgtgtgtcctggtccacttagtgcatcctcctgtgttggggcagaagcagagggaacggatcaggcagttcaacttttgtgtttcctgaaaaagtaaattgtactctgagtaacggtcagatggaaactttgtcctttgattggggaagaagatttttcagtttctcaaattgctgaggcatgaaaccagccaacacacaggtcagtggaagtatcagttaccagacactgcagataaaaaagaggaacccagtttagcaagggtgtcttgtcctgtggttaatatttatttctagtgaagataattttcttaagtgttaaccttttccatttttgatatatttattcatttattgaaaagaccgagcatcagtgagaggcagagacagagagagagagagagagagagagagagagagagagagagatctcatgtgctcgtccttccccagatggggctgcacaaggccaagctcagagccgagaactccaccttggactcccggtgtgtggcagggatccgtgtacagctgttcccctcaaagtgtgttctatctattgctcttttacgtcacaccaaggccattaggggataagagaaagcagaagctgccctggccccagtgacgtccaccaggaccacactgaggagctgctcagcttctccaggttctgggctgtgcaagccctgcagcccctgtcacaggtggagcagcagcagcaaagctgggctgagccgtgaggagagcgtggacctctacccacactggtcctctctctgctgagacccccagagagacattctctgtaggaaacctgtgcaacctgggtctgatgtggacacctggtggcactgcacctgtgtacaggtgctgagggattggagagaactctcctaactgattgtgcatcttagcaggcaagagggattacccgtagtcccatggtgagcaggtgcgggtgctgggatttgggttcaggtctccataattttgaacctactcattccacatggccgagttcattccaatggctgagaccagagtataaataacacaggagatagcccaggatggggtgacacacagctcctcactgtctctgcctcactccacggggacacaaatctgccatcagtccttcctgcagctgtgcccccgactgccattctctcagagcctcctcaaccccaggggactgcatgtcagtgtggggcagggcctcctctgcatcccagactctttcctctcctcctccatcccttctcatccctccactcagtcctacctctcatgtccctgcaacgccaatttctcccctctgtgtggacacagatcaacaaagcgaagcctcctctccactcttgtcctttgatagctaacactgcggatgtcacatacctacactgacaggaggtcatcaagatacttacccaacagattctctctcagaggcactgtgtgctcgctcagcttacagtcagctgttctctgtgtgctgtagaatggaccccacgtgagaacacagtgacactgggaggatatcagagcccagccactcactcaaaagggaagagacactgacttcaccttccaaggtgtgaccaggtattctctagagaaaggactttctcctacagatccgaacctaaccgtgaatagattataccatcagtcgttcagtccacttaaagtgttggcaaatgtccctcagtgtctttgggatgtgttatcttccagtagaagcacactcactgcaggtacacttgtgcaactaaggtctgagctggggagtggagacacagcccctgggctgagttctgtgctgtcctgggcccttcagctgggcacagccctgccccgcccatgctcatttgcatgtccccagagcaccgcccacctctctgggcatttaggagcaggctgctcccaccccatgcaggaggcagtgccaggcaggacccagcatggacacaagggcccccactcagctgctggggctcctgctgctctggctcccaggtaaggaaggccagcagcaggaacggcctcgggcagtgtggccagggctgcccgtctctgcaggagcgtcctcttagaacgtgaggatgagtgtggtctctgtgtttctgtttcccttctcagg

SEQ ID NO: 130 - DNA, 11693 bp, Oryctolagus cuniculus
cacagtgttccaagccctaacaaaaaccccccaggacagcagaagtgtgaggctgggctgccccagctgctcctcctgggccccatctgctgagagtgattctcagagcagccaggcttgaaggtcctgcagggtcgggtggaaggggccaggctgacccctctgaggctccctcctttcctcctccttggtggcagtctcagactcagtaatggctctaatatattaaggagagcaattatttactggggtctttgagtgtatagtgtcatttgagattcatagagtaaaagagaaaatattatatgtatggcaagcaaaaatagtttaaatcagggtgagtggagtcttccatgccctccatgtcctgggagaacggctgtcagagaaggagatcgtggacacagagactctcagattctcctagaggccaagcagctctggggcagaaggcacaggtgctgcccgcgtgtcctcagccctgtccaggaagccctggagtgggggtgctggtgctctctctgcctgcagcactcacaggggattctcccccgccccactgttcctggctctgcctgcatgagttgattgacagacgagaattctgattgtcttgtggtcaactattttatggtttgtcttgagtgcaaaagtgcccaaatatgccatcttgatccaacccaggtctctacatctttctgtgttttctctccacgtggcaatattccctctatagaggaggccctggcttccacagcaggaccagaggcacaaccaggatggtgtgaaatgcaccgttcactgcacccctgcttcagtccatgctgacccacacctgtcatgcagctccttctgcagtttggccaccaaacacagttctctcacaagcagttcacaccccagatgacgttgtttcagattctgggaaagtaagagaagtcgcgtttcctaaccttcctcatctcctctgtcccttctcatcctgggtcagtgctgccctctaaggtcaccgtgttctaatccctgcccccggtatggaagcagatacacagatcctaagctcttcttccactcaggttcctgcttgggagccccctgccgtcacataccgagactgaagagagatcatccaagctgtttcacccagcagagttgtatctaagaggaatgctgtgccaactcccctcacaataaactgctgtttgcctcttgtcaagacacccaatgggagcaaagtgaacactttgggatgtcagagcaggaccagggaggaggtgaaaggcgttatcttccttggtgtttgcttggtgcattgttgctgtaatgaattattccattctctttggctcagacaactccaggtgtattcttgaggtcaggagctcagcgctctcctggaagaagccctggaggcaacagggttgtgctggaaaccacagggcatgggattccattccaggtttgtccagcgtcaggatggccacatttcctgctctgtggcccattcccccttgcactccacggcctgtttccctgtcacagcctttggatcctgcccctcccccaacttcaggaccactgtgatagtatcgctcccaccaggtccttctgcgtcatctccccatcacagtccttaatcatccaacctgcccagctccttagatgacagacctggcgagcaggcagtaggctacggatggcttctgtgttggagatgatttgtatcccatcttacactcttaccatctctgccactgtctcccttgagacagaattagagctgatagggcagatctcagagcaacagagttggaggagatctagaccgaggtgcagtgacattgacctgtgtgtgggagggggcagggaattttaatgccgcctctaatgtggacttcatggagcacagctgcttggcagagtttgataaatgcagtgtggttttagaactcagaatctgatgagcgccctagcaaagagtggctgttctccaggctcattcctattgttgtgagatgggactcaaagttcagtaggttattttccttggttgctttagagcaaggcttgttcataaacttcaatgttagtttgtagctggcccatttctagcttctgtacctctgcttgcttgataatggccaaggccactagactgtggtttctcctgtctcctctcgcctgcagacttggaatagctcaggagccgtcaaagttacaaaaaaacctggctaattagctaactgcttctcccttctgtacacctgctttctgctcacacaagctcacacacaggttcaaatgtctcataaaaagtgggttctgcctttaaaaagcccccaccgccgcaactcagggctgtcttctctggacttgctctgtaacggggccgttgccagcctgctcataaagactcttgatttgagttcaaaatctctctgtgtcttaatccatgcgccccactacattgtaaccagttggatgatgctcagtgtgttgtataagcttcattttgggcatgtctattcttctgctttgctcattaacacagacccagtgcctagagactggaacttggtgtatagtagtagacaggaaatatttgtcaaatgagtaagtgattgcacacatttacatgtgtttgcacaatttaactgagacaggacaattgctgtccctacaacaaagcccccgagagtttcagagtcgtggattcatcagcttcttggagcctccacagtgaagatctcccaggcagctgcactccagatgtgcagagctctctccctgactcgtagtcagctccctgtaggagtggccggcagccttcagttggataaaacttacatcccccagggtctctgctccttcctcttttcttacccaggagctagttctgtattctaaggacacattggtttggtttcatccaccatgtcacaggatccatgaagagatgcatggctctgtggcttcctttgctttgtcttccatagtattttctctctctctttctcttcctttcttcctttcttcctttcttctagttatttgagaaggagagttacagacagagagagggatagacagagataataaagttttccatctgctggatcagctccctaatgttcccaatggccaatgcctgactgatccgaagccaggagccaggtgtttcttctttgtctcccatgtgggtgaagggacccaagtgcttgggccctcttccactgctttcccaggccatagcagagagctggaatggaagaagagcagccagggtacaaaccagtgtccagatgggatgccggtcctgtaggcagaggattaatgaacttcaccatagtgccttcccctcaactgacccttactcatcagcgacaatttgtaaccctagatgccttgtcacagaatccaggggattgtgagcagttaatttagatacttaattcaacctcctggatacttcagaaagtgcatggagagaatgaggagagaagcttgtttttctgcaagaaatgttgaaaccatgcataatttttcataatacggattttccccatcttttgaagaccgcttgtgaatgtggcatcagtacacggaaggtatgagtgtgctgggtagaacaaggacagcaggtgcacaccactgtctctcggagtctctgatctctgtgtggactccgctcctctgggacaagcgaagcagcctcgggtcacccacagctgccctctgtggtttctctgcacaaacccatctcggagcacgaggccccgcacactggtcagtccctcttgtcactgtctgtagggctgtctctttgtgcttaaaaaattcaaattgcttttaaagctgtttatgcgacaactaatttggaggtgagggcagtgaaaatggcagacaagtaggtgggagaggagaagcccgagagccaaagtgagctggaactgctggagttacagagggggaagtttcaggcgcagcactgagaagccatcagctgagaggaagctgagccctcccaacaaaacctacagagatctgcaggtctgcattggccacaggtggtcagatgtccaagacagcatcagccacatgcaccagctgggtcaataagcctgcagagactgctccacctctggctgcaaactccctctcagtagcagggcttgtaatgaagatgaagatggggaaccggagcagaggcctccaggagtcaaggtgaggatgaggagcactggaaggattcgccagcatcagccgacacatccctgcaggagggaaagcacgggttttctgaggagcagaggctctgggagccagatatcaaacctcatgctggaaatggccgtgaccaagacaactgaatgacgcgttttgtaactggggatgggtgtggggtgggtgtcaagttgaaaggaacaggttccctttttgaagaatggtataaggcagtctctgaagctgctttgttttcttctttttcatattttttaaatggtgtcaaaagggaacaatttcccttttgaaagaatgatattgttgtaccagctcgtcagctgaaatagagtattacaataccagtgacagtcacacaggaattttattgaaaatgagaagcaactgagagacacatgagaggcaaggtaaccaatcaggaccggccaccaaccgggaccaacactccttaccagagtgcggcccccaccagcagcttacacagctttttatggtattctgtccactagggcaagcaatttcaaaccggacccctggaatgcagtgaacaataaaaaggataaccagaatatggttgtaagataacagttatcaataacaaactcaggaacagacccaagatatggttgtaagataacagtgagggacacatttcagtcaacctagttcctgggaatttgggcccacatagttgcataagatgcacccttagccgttagcaagcaaagctaatatgtgcagaagcaagagatctgcaataggcttttagccacactcactgcatttggattctgattctacaatataaggctgtctttggagccactttttaattttttttaagattgagtgttacactgtaggagttggagtccctagcttgctaaatgctggtttctcactctggcttgcttgcttgacagctgtaaggccatgacaggcctcattctggactgggaaggaggcaggccgggtccttgagaacaaagaaagtaagctcctctgggatttatggcccaatgcttcccgccagttcctccctgtgccatctcctttgtgtggcgttcccaccacataatgtatgaaccaatggacatgttagttcccaataccttgccatatagagaataagaaggtaacctatgcgagatgatatgcacccttgtaagtgtgaggctacaaaaacctcttttatgcaaacgacagggccttttgcctgtgcactgccgaaggctgtgtgcggattgggggtcccagacggctggtaacaaataaacctcttcgtttgcatcttcgactgtgccttgtgcattgattgggaaatttggacactacaacactaacaaatgagagcttgaaattagaggtcatttttgtctatacacagatttcagatatttgctgagtttgtagctttgtgtgatcagtttgcaaaggtaagagataatatagaagtcagaatggcacctgttaaagaattgcagatctttagacattactgttagcacatccagagggaagtgcaactttattgtctctttagagctgtgagtagttaactctcctaactccctccttccctggactgacagccaaccagagcagctttctacagagaagggggtattgtactgagaaaaagagttactattgactgaatctaaattgagataaaatgaaatacagccttttctacatgggcatttgttgggtttgaagtcaccataaactcggtgttgcattgctgtcagtggataccacagcttagctcttttaaaaaaacaaaattttaggtaaactatggagtatttgaaatagcctacttcccttaaggggtcttgtcttccttaatttgtcttccaagacaaccgtttgctaccaagtgaatcagtatttccaatgtgcttctcttggtttttgtttcttagctagttcttgtaggcatttctaccggaacttgaggcaaatcagaaggaagttgattcttttaaaatagaaaccaccaccaaaaatgtctatgtacatattgctgaaagtatttggctattttaaaaaatttttaaatgatataaacaccaaaaaattaacaacgtataaagatggaaaatggaagattcactgtctataactttgtctgcacatttaagttactaagttgtaatcatatttggattaaacacactacattggctttttttttttttatttgacagagttatagacagtgagagggagagacagagagaaaggtcttccttctgttggttcactccccaaatggccgctacggctggcagtgtgccaatccgaagccaggagccaggcgcttcttccaggtctcccatgcaggtgcaggggcaaaagcacttgggccaccctccatggccctcctgggccacagcagagagccggacttgaagaggagcaaccgggactagaactcggtgcccatatgggatgctggcgccgcaggtggaggattaacctagtgaaccattgtgccggccccaacttatttttttaagatgtatttatttacttcaaaatcagaggtgcacagagagaaggagaggcagagagagagagagagagagaaaaaaagagaaagagagagagagagaggtcttccatcccctggtttactccccaatgggccacaatggatggagctgcaccaatctgaggccaggagccaggagcttctttcaggtctcccatgggggtgcagaggtccaaggactcaggccatcttctactgctttcccaggccatagcagagagctggatgggaagtggagcagccatgtcgaactggtgcccatatcgaatgcaggcattgcaggcagtggctttacccactgcatcacagcactggccccctccaggtcatcttattagcacagttatatcatttaatttaagagcatacatactgaccagtgtcctctccaaggcacactttaggcactgatatatagagaaaacgcatctgcaaacatattgtacggagttctcaccacatatactctatcggattttttttttttttttgacaggcagagtggacagtgagagagagagacagagaggaaggtcttcctttgccgttggttcaccctccaatggctgccacggccggtgcgctggcgctgatctgatggcaggagccaggtgcttatcctggtcccccatggggtgcggggcccaagcacttgggccatcctccactgtactccctggccacagcagagagctggcctggaagagaggcaaccgggacagaatccggcaccccgaccgggactagaacccggtatgccggcgctgcaaggcggaggattagcctattgagccgcggtgccggtcaaatatgacctctttttttaatgtgatggttaaactcatttcaaaatataggtctcagcaaaaaaaaaaaaaaaaaaaaaaaaaaaaaaaaagggatttcgcgaaaactcctgggatgttgaacgtggaggcagctccagactctgactggggtcaccactccttgagctcttctctaggtgatagctccagagaagcagcctgtgggtgttcctaacgcgtcgtgcactgacctctaagtctagagtaagccccagtgaaacactggaaatgcatatagaactgttagctcttccatggttttatcataccaagatacatgaatttaacttaattaaatgcaggcaaagtatctgaattttgtccatttaacttcttaaaataacatccctctcctacacactgatttcttgatccaatggaaatacttaaccttaggtcaagatgggagagacatgaatacaatgaatgcttttactaaaatactaataaatttctcaaacaacaaaaaaagacaatttcatatttcaatatctacattttttaaaaaaagatttatttgcttatatgtaaatcaatgatacacacacacacacacaaataccgagaaagagagagagagagagagagttttcttccaaatgctcttacactctacaaatggctgcaatggccaggtctcccatgtgggtttcagagcccaatcacttgggacatcttcagctgattttccaggacattcatatgttggaacaggatttgaagtggagcagccaggattccaaccggtgcccatgtgggatgctggcattgcaggggtggctttacccactgcaccacagagctgccctgtcgtgtgcatgttttaagagcatcatgatagttcaccatatgctccatcctgcctcactcccaccctcagtgctcttccttttttaatttttatttatgttatttttaaaaaggatttatttatttatttgaaagtcagaattacacatgggaggagaggcagagagagagagagagagagcgcgagtgaggttcactccccagttggccacaatggcaccaatcagataccaggagccaggaggttcttctgggcctcccacccgggtgtaggggcccaaggacttgggccatcttctactgctttctcaggtcattgcaaggagctggattggaagtggagcagccggaactcaaaccattgcccacatgggatgccggtgcttcaggccagagctttaatcactgcgtcacagtgccggcccctattttaacttttgaaatgacatactttcaatgtactttataaacactagctcagccttccatatatacagaattccccctatccctctgtcattaccagacctgaggtgcactggctccccctgggggtcacaggtggaatcgcgtcagctttcaatccctgatagagcagttcttcatttaatctgaaatcaaatagagaattctcatggaactgaaccaatagtaacttcattgtttgcatgcaatggcacacaactaaaggattcacaatctttgtagacgtagattaaatgggaaactcgaacagaaccctttatctcatagatcttccattgtagtgtgagggctgataacattcaaaccaataatgttctacctctgctcctgatattggaatttgacccccctagatataatttagggtgccataagatatcaccatgtgcttattaataagttccccatattaataagccaatgtgggttcttgcctagtattcagagaagaattctgaatacaagcaaaaatgagtgaggcagcatggtacattttaaacttttattcagtgagaaagatgcataggagatgagggccccgtctaaaggagagaggtagagctgggttcacaccaagtaccaggaaccagccatgtggaggagcatctaggaccagcgccatggggcagatggaccaaaggccacatgccatggaggcacagggctgcagccagccccctactggcaagaagccagagaaagaagggagggaaaaaggccagacacaccttgtctcaggcttttaatccacttccaaaggggagtggttaattcacctgattggccagtgggcactcaggtgtggccaggtaggggcatgaggtcacacaggggcgtggtgaaggtgtggtcttccagctcacaaacctaatcaatcttaacctgtgtgcctgcttccttcactcccactctgctccatgtgagaggcctcccttggagcaatgatattgctcaggacaggtgagcagtgggtatccaagtccacttagtgcaaccccctgtctcagcctaggcaggggcagaggcagaggcagagggaataaagtaggcagttcaacacttgtgtttcctggaaaaacaaactaattggagtctcattaatggtgaaagccaaattgtcctttaatggaggaaaaagtgtttaaaatttatcatgttcatgtagcacgaaaccaggcaacacacaggtcagtggtaagagtcagtgctctgacactggagataacaaaaagtggagcccagttttaagagtgtcttttatcgtgtcaacagttatttctagtatgttaattttctgtaatgttaccattctctacttttccaaaatatttatttatttacttgaaacctgagcatgggagggaggtaaagacagagaaagattaggagggagagaggagaggaagaggagaggagaggagaggagaggagaggagaggagaggagaggagagaagagaagagaagagaagagaagagaagagaagagaagagaagaggaggggaggggagggcaagggaggggaggagacgggagggaaagtagggaagttctataatctggtctctccacaaatggctgtaacagtgagttcctggccaagcagaagcccagagccagaactgcccctggtctcccctgtggggcaggaatccaagaacttgggccattttctggtgcctcccagggtgtgcatttgcaggaaatgggatcagaagtggaacagtggggattctaacctgactctgacataggctgctggcattgcaagtggcagcttaatccactgtgccatgatgccagtctatcctcctctctagcttttcttaagaataaagtgaaggttttaggacagaggagagagggaagttagtttgcttgatgttcctcagacctatggtgactccttgaaacttgcacttatctcttcctgttgtatccttgactcagaactctggctgcaggtggggagccgcacatgtgtgatctctcatctaagcacctgcgttctccttctgagtcctggtctctcgcggccgcttgttctgaggatgtttattctgagtcagtacagaggtgagtgtgggacagaagtctcgtctctcagagaccatctccctggtgcagccgtctgctaaaggtgacaacgtgaggccatcagaggacaagaaggtaaaatcaatgatctgagctttaatttgtaactgatattccctagaaatttctttctcctacagaatccaaacataaccatgaatatattatgccatcttggcctccagttcacttaaagttttggaaaatgtccctcagtgactttgggaggtgacgtcctctggtagaaacatgcacactgcaggtaaacttgtgcagccctggtctgagctggggcagctggagacacagcccctgagctgaactctgagctgccctgggcccttcagctgggcacagccctgtcccgcccctactgatttgcatgtccccagagcaccgcccacctctctgggcatttaggggcaggctgctcctgccccatgcaggaggcagtgccaggcaggacccagcatggacatgagggcccccactcagctgctggggctcctgctgctctggctcccaggtaaggaaggccagcagcaggaacggcctcgggcagtgttgccagggctgcccgtctctgcaggagcgtcctcttagaacgtgaggatgagtgtggtctctgtgtttctgtttcccttctcagg

SEQ ID NO: 131 - DNA, 10063 bp, Oryctolagus cuniculus
ccacagtgttacaagccctaacaaaaaccccccaggaaagcagaagtgtgaggctgggctgccccagctgcccctcctggccccatctgctgagagtgattctcagagcagccaggcttgaaggtcctgcagggtcgggtggcaggggccagggtgactcctctgaggctccctcctttcctcctccttggtggcagcagcacagacatgaccatgaccctactgttctaaagtaaaacagttattctttctgagtatggaagctagagcattatttgagattcatagagcaaaagagaaaacattatagatattacaaggaaaaatattttaaatacaggtaattttttataaaggatacaaatttcacatgtacagttttttatatgtagagttgaatacatttattagcttatgaaagcccatgctttaacagacacacacaaacacacacagtggagagagagttctctttcatctgctggttctcttctccaatggctacaccggctgagactgtgcctgccaaaagctgggagatggaaattcttttttttttttaagatttattttattgatttgaacgacagagttacagagagacatgcagtaaaagaagtcttctatatgctggttcactccccaggttgctgcatagccagagctatgccgatccaaagccagcagccaggagcttctaccaagtttcccatgttggtgcaggggcccaaacatttgggccattttccactgctataccaggacatagcagagagctggatcagaagaggagcagccgggactagaaccaccgcccatatgggatgctggcgcttcaggccagggctttaaccctctgtgccacagcaccaggcccgggagatggaatgtctttcaggtctcctatatgggtgccaaggctgaaacacttgttcctgctccctgctgtggcctgagaaagcagtagaagatggcccaagcggctggacccctgcgcccacatgggagaactggaagaagctcctggctcctggctttggtttggcgcagttccagccaatgtggccagttgaggagtgaaccagcagatggaagacctctctctctctctctctctccctctttctttctttctctctctctctctctctgcctctccatcactctctgtgtaactctgactttcagataaataaataaatctaaaaaaaaaaaaggtgcagggaagaagaaggtatgtattaactttcctttgtgggcttgagaacagtgagcccctatcacagcctcctaatggagtgcagctggagtgctcacaacagtcaagtcacacagagattctgtgcagccgctgtgctgggctttgcacggagagagcggtgtgagaagaggaaaagagctcagattaggagctgaagagcctgctttagtctcagtgctgctgagcgggagaagaccaggtgctctggcctcctgttccctgagtctaggtgggagggacagagggcttcccaggttccttttgctgtcaggctctttgttatgggggtggaaaaggtggaggtgcagtgttgctgggagctgcagagcatccgagtggacagcagcgggcggggaccccgtggttcagaagaaagcccatcttcagtttcccaccaggtgcccactggcttttttcccatccactaacagcaaatgttcacaacaggaaagctgggtgtcgtttaccgattgtgacgaacgcatcgatgtgagctgtcagctgggtgtgcagtggaaaggcactgtgtgtactgcttcacaattttttgatttgtaaattataagctattctgaaacggaaagtttctttacacaacaacaacaataacaacaaactgagtatcacagcgaactgtgaaaaagaaaaaaatttacctctggcgtgactttagtgttcatattgtcctgctgattgtctgccagaggctgacgggcatctgcaaatcagaaatcagccctggaaagagtcttttaaaattgtgtatgtatttatttttatttgagcaggagagagagagaaagagagagagacagagatcttctgtccactggtttactcccccaaaggccaggctgaagccagtagcccaggactccgcccaggcctcccacgtagatggcagggtcccaggcacctcagtcctcactctcagggtgcacatgagcaggaagctggcatcaggagcagactgggattagaccaggcactcagtgtgggatgtgagcagccaagggccaggctgatgccaggggtcagggactccatctgggcctatgtgggtggcagcagccaaagtacttgggccaccatctgccgcttcccaggtgcatgagcaggaagatgcatcagaagcggagctgagactcaatcccaggcactcaaatgtgggctgtgggtgttccaagtggcagctgaagactctgccacagcatccactctgcctaatttctattatttatttccttccagtgacttttggtttggtttttctatgtcttgagatcactgtcacattttaatttgatgtctttcaggttttttttggatgtgagtacatattgcattaaacttccctggcacctggctttggcctggcccagccctggcatttgtgggccctctggggagcgatttctccctctctgtgcctctgtctctccctctctgtaactctacctttcacataaataaattaacaaatcttgaataaaaaaaaggcctgagattgcagtttccctgcagccacttgctcaggggatactcccccctccctcagcttggagaatcccagttcacgtttatccagctcctcagaccaggagtcaaacgcagagcagtctggatgggctgcctcacaagcaactgcctgcttccaggtttcacacgtttcttatggggtgggtgcatgcactcgtcaggtttaaacagcatggattttggtgttgtgaatcacatcgagaatccagcaggatactagaatagttaggatcttggtcatggattacgcaggtgcactgcgttcccacacttgatgttacctatgtgcacaaacagtgaggtcgctcatcattttcccacgatggccctgggctgtgaagcttcctccccttagggcgcagcagtcccctgggtcacagagtttgctgagaagctgtgctccttgggggactgactgaaagcaagagtgtatcagattacattagtcccaaaagtccaggaggggtagagggacgatgatctgtctttagagctacttcctgctgacatggggtgatgaggtgctctctgctggcatggggcgatgtctcaagccgctgtctcctgggtggagagctgagtatatccctgtagcagcattatgttgaccacctggttgctgatggccttggttcgttcccttatcaactcctgtaaagacttaaacagacgcggtagtataaaagacagagtgagaataggaaccaaagatcctaagagtggcattaaccaggtaatgagaggtttcagagaggagaggaaatgggggagggggctctggacccttgtgagacctgtttgatggacgtggttcaaagctgatcccaagcaaccgggagaaaggccactcaacttttgcaggtagaggggtttgtctgtagggaaattctgaacaatcatacaacatcaggtgggggagaggcccatcaatacacacaggtcaggagcaaatccattgatgttagagcagagactatgattataaaggaatgaggccccaagtgggctagatagggtctagaacaaaggacagagtcattactagaggacccaagagagctgctgtctaaaccatgactgagtttctgattgagaggcaaatagaaactgacagaagaggcttgataataatcaggtgggctttaaggccttgtcagttatgaggcccagacctatctatctcttcacatgggttacatcctaagggaggtgtgaacctcttggggaagacaccctgttgacttccattacctagctggcctgggaggagagctggccgggtaaaggcaggtggcatccctaacaggaaacttacagttctgcctgcaatgttgctgaccttacttggctgtcccctcagcagtggtggtcactttggaagctgggctgagtgaagggctcttcagcttggagccagcaagatctgtggctctgacctgggcgtccttcgactccagggcagttccatttccagagatccaactcttggctggcagagctgacagggctcttcctagctgacttctgctgaacccaggcttaccacactgaaagccactcagcgcactggcctgttgggtctctttgagggcagatcactgtgcagagctgccccctctctttaagttgcttctgatgcctagcttccttttcctcctggtttttgtcaaagcagaccagaggatgcaggtgaaggaggtgctcatgtcccatctctaatcttcggtggcctcaactagaagcctaaagtacaggcatgttctgatagtggttttccctgaggtagacaatgcacatgaggaaagctatgtcctcactttcaaactttctctccctctgtttggtctgaaagggacgttttgcctgtttactgtgcccatggcgaagtaaatccagctgtgaaattataatttaagctttccttttggttatgctattacagaaatctgttagccatctttttacaaggtctaaaaatcaaattgtgcatctaggagagtcctttggaatagagttagtttcctaccttgaagagaatagagaaatgagaggacaagttgggcttagaatagagagatgagggagcaagtcccagattgcttactgaccatagcattatcaaatgaaaacttagaaaagaatttcaaccattaaatgacaacttaggacaacatttaccagaaggtccaatgccttctataaattttaagaacacatgtatttggaaacatctcttaaatatctaacatggtgtagcttgtttaaccagcaaattcaagcacaaacatatagaaacctttttagtttctttctacaaaccaagttaaaacatctgatacagagattcaggtcacatggatcaaatgtatctttgattaattttatcagtttaaatttatgggcaatcttttatctataagccaaaaaataaagttcttaatgaattttcccatgtagacatacaatatgtatacacatataacaaaagagatagaacagtaaaaccatttccacaatagctttttaaactcttcaactgttttttaggttaccattgatttggattacttcctgctcttagttacctgaattaaccctgctttcttccaggtggaacctgtagtgcattattggcttcatctgtttacagagccatcccaaagtactgagtacagcagaagtggctgggaaaagtccatcagaacctatacaaaactgtgaatgacagaagcctttatatagccatgtttaaaattagaaaccatgaaccaacaagaggcagttgtgtccttcacacagtagttttgaaagcacctgtagggttttacagaacatttaactgtttaggcctttgggtttttctcattaagataatcatcatgtctagtaacacaagatcattagactttttaactttaggacttttttttttttttttttgacaggcagagtggacagtgagagagagacagagagaaaggtcctccttttgccgttggtcaccctccaatggccgccgtggccggtgctctgtggccagcgcatcgcactgatccgaaggcaggagccaggtgcttctcctggtctcccatgggtgtagggcccaagtacttgggccatcctccactgcaccccctggccacagcagagagctggcttggaagaggggcaaccgggacagaatccggagccccaaccgggactagaacccagtgtgccggcgctgctaggcggaggattagcctattgagccatggcgctggccaggacatttttatcagtagcattttatatgataaaacttataatttagtaccacttcacatcttgacagtacttctagtataatccaaatagcctgattagttggtgtctcttcaagatgagagacacatatcctttgatttttccagttggttgggcccaaactggaaaaataaaagtccactttactggaaatttcagagtccaaattctttgtaactttgatttttgattttttggaatgcctgtcaaggatgccaagaaagcttaaagtatctgcttgaaataagatccttcaccatcaggacataatatagaccaaatttgatcattgttagaagacgattattcaaatgttttagaataagcatttatttaaataaaccaaagctcttaataaaacactcagctgtttctaaacttttagaatttaacagcggcatcaagagaacataatagattacttttgatggaacaaggacataagcctcagcgattctccctcagtgcccaatggagataaactttgggatgtattccttgcccttgaatctcaattgggtctgacaccctattgccttcataccccaccctgcattcttttccaggttcaaaaagcatccccccacctccagttcctggaattcccttccctgctgcctcctacccccaccccagccctagccctcctggcctggcatctgggagtcaaggccttttgccacaggctccatcttgtacacacaggcagttggtcacccacctctgcggatttattttctctgaataaattcggtctgtctgtaaattcgtgcattgcctcttctctaatctgcaatggaggaataaccaagtgagtcatggcactggccccttaaacccatctttaaaatagatgtctcagacaaaaaaaatagtgtaaggatttcatgaaacctcctgagatgttgaatgtggaggcagctccagactctgactggggtcaccactccttgagctcttctctaggtgacagctccagagaagcagcctgcgggtgttcctaacgcttcctgcactgacctctaagtctagagtaagccccagtgaaacatggaaatgcatatagaactgttagctcttccatggttttatcataccaagatacatgaatttaacttactttaatgcaggcaaagcatccaatttttgtccatttaccttgttaaaataacattcctctcatacatactgatttcttgacccaaatggaaatacttaaccttaggtcaagatgggagagagatgactacaatgaatgtctttactaaaataccacacacacgcacacaaatgcagagagagagagagagagagagagggagagagagagagagttttcttccatctgctgttacactctacaaatggctgcaatggccaggtctcccatatgggtaccagggcccaatcacttggtacatcttcagctaattttccaggccattagtatggagctggattcgaagccagcactccaactggtgcccgtgtgggatgttggcattgcaggggtgtccttattcacaacaccacaatgctggcccgtcatgtatatgttttaaaagcatcataatagttcaccatgtgctccatcctgcctcagtcacagtgctcttctttttttattttgatttattttaaaaggatttatttgtttatttgaaattcagagttacacagagaggagaggcagagagagagaggtcttctatctgatgattcactccccagttggccacaatggctggagctgtgccaatctgagccaggagccaggagcttccatttctcccacctgggtgcagggccccaaggatttgggccatcttctactgctttcgcaggccatagcagggaggctggaacagaagtggagcagccgggactcaaaccatcacccacatgggatgccggcacatcaggccagggcattaacccgctgcaccacagctggcccctgttttaacttttgaaagacatactttcaatgtactttataaacactagctcagccctccatatatacaaaattcaacatgtagtaagcagaaaaccactgttcctcatcccaaagacaaggctttgagtctcaatccccccaatacctctgtcactaccagacctgaggtgcacttgtgccccctgggggtctcaggtggaatcatgtcagctttcaatccctgatagagcagttcttcatttaatctgaaatcaaatagaaaattctcatggaattgaaccaatagtaacttcattgtttgcacacaatggcacacaactaatggattcacatctcttgtagatgtagactaagtggaaacatcgaacagagcccttcatctcacagatcttccatggtagtgggcagggctgatgatactcaaaccaataatgttctacctctgctcctgatattggaatttgaccttccaaaaatataatttggggtgccatacgatatcaccatatgcttattaataagttccccatattaataagcccatgtgggttcttgtctaatattcagagaattctaaatgctggcataggtgaacgaggcagcatggtacattttaagcatttattcagtgagaaagatgcataggagagtgagggccccgtctaaaggagagaggtaaatgtgggttcataccaagtaccaggaaccagccacgtggaggaacatctaggccaggaagcgtggggcgggtagccaaaggcaacacaccatggaggcacagggctgcagccagccccctactggcaagaagccagtgagagaagggagggaaaaaggccagacacaccatgtcccaggcttttaatccacttccaaaggggagtggttaattcacctgattgaccggtgcccactcaggtgtggccagcagtggagcagtggggaatcaaagcagtctctgatgtaggctgctggctttgcaagtggcagctaatccgctgtgccacgatgccagccttccctcctctctggattttcttaagacaaacgtgaacgtttctgaagaggggagagagggaagttaatttcattgatgttcctgagacctatgatgaagccttgaactttcacttctttttttgttatgcaacctgatcagaactcaggctgcaggtgggagagcgcacacgtgtgatctctcctctaagcacctgcgttcttctgagtcctgatctctctctggcagccgcttgttctgaggatgtttattctgatcagtttcagaggtgagtgtggacaaaagtctcctgtctcagagaccatctccctggtgcagcggtctgccgtgaggggacaacgtgagggcatcagaacacaagtaaagaaatggccttaggcaaaattagtttactatctattttaaagaaaaggaaatttctaggcaaaaattagtttactacctattttaaagaaaaggaactttctcctacagatcccagataaccatgaatttattacaccatcttgtccgataaactcacaattttggcaaatgcccctcagaaagtttgggaggtgacgtctcatggtggaaggatgcacacatcaggtaaacttgtgcagccctggtctgagctggggcagctggagacacagcccctgggttgagttctgagctgccctgggcccttcagctgggcacagccctgccccgcccatgctcatttgcatgtccccagagcaccgcccacctctctgggcatttaggagcaggctgctcctgccccatgcaggaggcagtgccaggcaggacccagcatggacatgagggcccccactcagctgctggggctcctgctgctctggctcccaggtaaggaaggccagcagcaggaacggcctcgggcagtgtggccagggctgcctgtctttgcaggagcgtcctcttagaacgtgaggatgagtgtggtctctgtgtttctgtttccctcctcagg

SEQ ID NO: 132 - DNA, 2509 bp, Oryctolagus cuniculus
ccacagtgatacaagccctaacaaaaacctcccaggaaagcagaagtgtgaggctgggctgccccagctgctgctcctgggccccatcttctgagagtgattctcagagcagccaggcttgaaggtcctgcagggtcgggtggaaggggccagggtgactcctctgaggctccctcctttcctcctttttggcggctgcagtacacactttgggtaaccttccgtgcctgctgagatgcagtccaataggagaattctctgatccatcagcacctgcacacaggggcagtgtccccaggggtccacatcagacccaggttgcacaggtttcctccagagattgtctctctggtgtctcagcagagagaggaccagtgtgggtagaggtccacgctctcctcatgcctcagcccagctttgctgctactgccccacctgtgacaggggctgcagggcttgcacagcccagaacctggagaagctgagcagctgctcagtgtggttctggtggatgtcactgaggccagggcggcttctcctttctcttatttcctaatggcctttgtgacataaaagagcaataaatagaaaacatggcgagggctatgatttataaaatggctgtgcttggatcctgccacacactgggagtcctacatggagttctgtgctctggactgtggccaacccagcctcagctgacaggctcatccgggaaactaccagcacatggaggattctctctctctctctttttctctctcactttgtctttcaccaatgctcagtctttcaagtaaataagtaaataaatatttttaaaaatggggaatattacatttaagaaaataaatgggggtcacatgtgcaatcgtgtcatttttcaatctctgatggagtagttcttgattcaatgcaaaatcaaatagaacattctcatccaatttcatcatagcagcttcactgttggcacataaaggcacacaatgaatagtagcacaaactcttagccctaaaataattgaaagaagtcgaacagagccctttatgtcatagatctttcattttagtgggccgggcagatgagaaacaaaccaatgacgttccaactgtgctcccactgtgtccatgtgatgtgcctcccatggagcagggccagtgctcaggacaatggggctgtgggtgtgcaggtgcatgtgtgcctccttctgtctccacctagacagggcagaggcagaggcagaggagagggaatgtatcgggcaactccccactgtgtttcctgaaaaataaactcattgtactctcggtgatggtcgggtagacaaactgtccctgacaaaagattttaagatttctcatgtccctgtagcataaagtcagtcagcacacaggtcagagggaataatcagtgcccacacactggatataaaaaaaatggagcccagttttagtgtgcattagcaggaaatgcgatcagaagtggagcagtagggttcaatccagtctctgatgtagtctgctggctttgcaagtggtaacttaatccatgtgccatgatgccagtctatcctcctctgtagattttcttagagataaagtgaagttttcaggagagaggagagaaggaagttatttttcttgatatcttcagacctatggtgaggtcttgatctttcacttttctttcctcctgtatccttgcctcagaactctggctgcagatgggagagtgcacacgtgtgatctctcctctaagcacctgcgttctccttctgagtcctggtctctggcagccgcttgttctgaggatgtttattctgagtcagtacagaggtgagtgtgggcagaagtctcgtctctcagagaccatctccctggtgcagcggtctgccgtgaggggacaagatgagggatcaaaggacaaacaggtgaaagacatggacctcagctttaaggtgtaactaagtattccctagaaaatggactttctactaaagaattccaccataaccatgaacaaattacaccttcttgtcctccagttcaattatagggttggcaaatgccctcagggaattcgggaggtgatgtctcctggtggaaggatgcacacatcaggtaaacttgtgcagccctggtttgagcaggggcagctggagacacagcccctgggctgagttctgagctgccctgggcccttcagctgggcacagccctgccccgcccctgctcatttgcatgtccccagagcaccgcccacctctctgggcatttaggcccaggctgctcccgccccatgcaggaggcagtgccaggcaggacccagcatggacacgagggcccccactcagctgctggggctcctgctgctctggctcccaggtaaggaaggccagcagcaggaacgggctcgggcagtgtggccagggctgcccgtctctgcaggagcgtcctcttagaacgtgaggatgagtgtggtctctgtgtttctgtttccctcctcagg

SEQ ID NO: 133 - DNA, 3073 bp, Oryctolagus cuniculus
ccagagtgatacaagccctaacaaaaaccccaggaaagcataagtgtgaggctgggctgccccagctgctcctcctgggccccatctgctgagagagattctcagagcagccaggcttgaaggtcctgcagggtcgggtggaaggggccagcctgactcctctgaggctccctcctttcctcctccttggtggcagcagcactgacatgaccatgtccctactgttctaaaggaaatcaattattctttctgaatatggaagctagagcatcattcgggattcatggagtaaaagagaaagcattatagatattaccaggaaaaatattttaaatacaggtgattattacattttataaaggatacaaatttcatatgtacagttttttatatgtagagctttttaaaatatttttgcttatgaaagcccatgctttaacagacacacacacacacacacacacaaagtggagagagagttctctttcatctgctggttttctcctccaatggctcaccagctgaggctgggcctgccaaaagctgggcgacggaatttcttttcttttcttctttttaagatttactttattgatttgaaagacagagttacagagagatgtgcagagaaagatgtcttctatccgctggttcactgcccagatggctgcaaaagccaagctgtgctgatccgaagccaggagcttcttctggtctcacatgctggtgcagcggcccaaacatttgggccattttccactgctataccaggccataggggagagctagattggaagaggagcagccgggactagaaccggcacccatatgggatgctggtgcttcaggccaggtctttaaccctctgtgccacagcaccaggcccgggagatggaatgtctttcaggtctcctatatgggtgccaaggctgaaacacttgtttctgctccctgctatggcctgggaaagcagtagaaatggcccaagcggctggacccctgcacccacgtgggagaactggaagaagctcctggctcctgtcttcagattggcgcagttccagccattgtggccagttgtggagtgtaccagtggatggaatacctttccctctctctctctctctctgtgtgtgtctcaatctctgcctctccttcactctctgtgtaactctgactttcaaataaacaaatctttaaaaaaaagtagcagagaagaaggtatgtattaactttcctttgtgggcttgagaacaatgagcccctatcacagcctcctaatggagtgcagctggagtgctcacaacagtcaagtcacatagagattctgtgcagccgctgtgctgggctttgcacggagagagcggtgtgagaagaggaaaagagctcagattaggagctgaagagcctgctttagtctcagcgctgctgagctgggagaagaccaggtgctctggcctcctgttccctgagtctaggtgggagggacagagggcttcccaggttccttttgctgtcaggctctgtgttatgggggtggaaaaggtggaggtgcagtgttgctgggagctgcagagcatccgagtggacagcagcgggcggggaccccgtggttcagaagaaagcccatcttcagtttcccaccaggtgcccactggcttttttcccatccactaacagcaaatgttcacaacaggaaagctgggtgtcgtttaccgattgtgacgaacgcatggatgtgggctgtcagctgggtgtgcagtggaaaggcactgtgtgtactgcttcacaattttttgatttgtaaatttaaagctattctgaaatggaaaatttctttacacaacaacacaacaaccacaacaacaacaaactgagtaccacagcgaactgtgaaaaagaaaaaaaatttcccccggtgtggatttagtgttcgtactgtcctgctgattgtctgccagaggctgatgggcatctgcaaataagaaatcagccctggaaagagttttttaaaattgtgtatgtatttatttttatttgagtgggagagagagagggaggggttcaatccagtctctgatgtaggctgctggctttgcaagtggcaacttaatccactgtgccacgatgccagtctaccctcctctctagattttcttagagataaagtgaaggtttcaggagagaggagtgagggaaattatttttcttgatgtcttcagacctatggtgaggccttgaactttcacttttctttcctcttgcatccttgactcagcactctggctgcaggtgggagagcacacatgtgtgatctctcctctaagcacctgcgttctcctgagtcctggtctctggcagtcgctttttctgaggatgtttattctgatcagtacagaggtgagtgtggacagaagtctcgaatctcagggaccatctccctggtgcaggggtctgctgtgaggggacaagatgagggatcaaaggacaaacaggtaaagacatgggcctcagctttaaggtgtaactaagtattccctagaaaatgcactttctactaaagaattccaccataaccatgaacaaattacaccttcttgtcctccagttcaattacagggttggcaaatgtccctcagggaatttgggaggtgatgtctcctggtagaagcatgtgcactgcaggtaaacttgtgcagccctggtctgagctggggcagctggagacacagtccctgggctgagttctgagctgccctgggcccttcacctgggcacagccctgccccgcccctgctcatttgcatgtccccagggcaccgcccacctctctgggcatttaggagcaggctgctcccgccccatgcaggaggcagtgccaggcaggacccagcatggacacgagggcccccactcagctgctggggctcctgctgctctggctcccaggtaaggaaggccagcagcaggaacggcctcgggcagtgtggccagggctgcctgtctctgcaggaacgtcctcttagaacgtgaggatgagtgtggtctctgtgtttctgtttcccttctcagg

SEQ ID NO: 134 - DNA, 3025 bp, Oryctolagus cuniculus
ctacagtgttacaagccctaacaaaaccccccaggaaagcagaagtgtgaggctgggctgccccagctgcccctcctgggccccatctgctgagagtgattctcagagcagccaggcttgaaggtcctgcagggttgggtggaaggggccaggatgactcctctgaggctccctccttcctcctccttggtggcagcagcacagacatgaccttgtccctgctgttctaaaggaaagcaattattctttctgattatcaaagctggagcctcattaacgattcatagagcaaaagagcaatcagtacttgtattccaagccaaatgagtttaactgcaagtgataatataaattctataaaaagtatcaatttcatagctacagttttttaaaaagatttatttgcttatccaaagtctctgctacacacatacacacacatacacacagactggtgggggggggggagaggaaggcgggagagagagagagagagagagagagagaatgaaactttgagggagagatagacgatagacttatcttccttcctctggttactccccaaatggctgcaatggccgagcagtgcccggcagagctaggagagagaactcctttcattctcccacatggtgccagagctcaaacacgtgggtcagctccaggtgctttccaggccaagcagggagctggattggaagatgagaagccaggactcccaccggtgcccatgtgggatgctggtactgtgtgaggtggctttacccactgcatgaggctggcccatcctatccacagtgatgagggcataatgccacttcccaccatgtcctccctcctgtgcggtccagccacaccagtcgaacggaacctaagggagggagagggaccgaaaatagggacaggagatcgcagagaatggagccaagacaacaagcctgatcaagtctcctttattcctatgtctcagtggtatttatacataaccagcagaaagaagcacaaaagataacaacatatgtaagcaacttatcggggctctggtaacgcagatactgttaacagagcgttcttgattatcatcgtccttcaggatgggagcatgtgactttcttatcccaagaactgcataagccaagactggctttgatttgtccaaaggctgcctgcacctccttccacccgcccccccccctcctcttctgtttcgtttaagttctacactgacgtactttcactctataatcaccagcttcaccctccactaaacaaagaattcaacacggagtagcagaaaaaccactgttcctcaagagtctagtcaaggtgtgagtctcttcctcccagtccctctgtcactaccagacctgaggctcactgctgcccccgggggtcacaggtggaatcgcgtcagatttcaatctgcttgagcagttcttcattcaatgcaaaaccaactagaacattctcatcaaattgaacaatagtggcttcatcattagcacacagtggcacacaaataacagtatcacaatctcctaggcgtaggattactgtaaaaatttggacagagcccttcatctcatagagcttaaagtttagtgggcagggagacaatgcacacacacagaaggttctccacctgctcccactgtgccgtgtgtgagattcctccctggggcactgccattgctcggtacaagtaggcagagtgtgtccaggtccacttagtgcatcctcccgtctcaggggcagaggcagagggaacgtatcgggcagttcaacatttgtgtttcctgaaaaataaaataactgtagtctcagtaagggtcagacagggaaattatcctttgattcaggaaaaagctttttaaatttcttaaatcactgaagcctgaaaccaggagcacacaggccagtggaagaatcagtgcccagacactggagataaaaaagaggaacccagtttagcaagggtgtcttgtcctataattaatctttatttctagtgaagataattctcttaaatgttcactctttccattttccataaagtttgtttatttacttgaaaatctgagcattgatgaggtacaaaatgagaaagactgagtggggggaggggagcaagagcgagagctagaaagagagagagagaatcttccatgtgctgctacttcctaggagatcctgtcagctgaggttgagtcgggctgaagaaaagagcacagaactccagatgactcccagtgtgtggcaggacccacgcacagccacttcttgaaaaatcatagccctcgccatgtttcgattcatggctcttttacgtcacaccaaggccattagggaaatagagaaaacagaagccgccctggcctcagtgacgtccaccagaaccacactgaggagctgctcagcttctccaggttctgggctgtgcaagccctgcagcccctgtcacaggtggagcagcagcagcaaagctgggctgagccttgaggagagcgtggacctctacccacactggtcctctctctgctgagaccccagagagacattctctgtaggagacctgtgcaacctgggtctgctgtggacacctggggacatggcacctgtgtgcaggtgctgaggggttgtagagaattctgctaactgatttgtgcatctcagcaagcaggatggtttacccaaactcgaatggtgagcaggtgctggttgcatattctaagaagttagcacatactccccagaataaaggactttctcctccaatatctgctccagatttaggagcaggctgctcccgccccatgcaggaggcagtgccaggcaggacccagcatggacacgagggcccccactcagctgctggggctcctgctgctctggctcccaggtaaggaaggccagcagcaggaacggcctcgggcagtgtggccagggctgctgtctctgcaggagcatcctcttagaacgtgaggatgagtgtggtctctgtgtttctgtttccctcctcagg

SEQ ID NO: 135 - DNA, 1752 bp, Oryctolagus cuniculus
ccacagtgttccaagccctaacaaaatcccccaggaaagcagaagtgtgaggctgggctgccctagctgctcctgggccccatctgctgagagtgattctcagagcagccaggcttgaaggtcctgcagggtcgggtggaaggggccagggtgactcctctgaggctccctcctttcctcctccttggcggcagcagcacagacatgaccatgtccctactgtgctaaaggaaagccttattctttctgagtattcaaagctagagcatcattgagattcatagagcaaatgagaaaatattatagatattacaaggaaaaatattttaaatacaggtgattataaaattttataaaggataccaatttacaaatttcatgtatacagtcttttaaaaagatttatttgcttattgaaagcacaagctttacacacacacacacacacacacacacaccccacccgccacccccaccccccacacacacagtgacagggagagagagagttctcttccatctgctggtacactcctccaatggctgcactggggcatgcaacttctttcaggtctcctacatcttctgtaacctgtgcactctacaaatggctgttacagtgagttctggcaaagcagaagcccagagcaaagctgcccctgggtctcccatgtggggcaggaatccaagaacttgggccattttctgctgcctcccggggtgtgtgttagcaggaaatgggatcagaagtggagaagtgggattcaaagcagtctctgatgtaggctgctggctttgcaagtgacagccttatgcactgtgccacgattccagccttaactcctctcctgcatttcctaagaaaagtatgaacatttcaggacaggggagagagggaagttatttttcttggagtttctgagacctgtggtgactccttgaaattgacttacctcttcctcttgtatccctgactcagaactctggctgcatgggagggcacacacttgcgttctctcctctaagcacctgcgttctccttctgagtcctggtctcaaactggcagttgcttgattcagaggtgagtgtggacagaagtctcgtctctcagagaccatctccctggtgcagcggtctgccgtgaggggacaatgtgagggcatcagaggaaaagcaggttaaatccatggtcttagctttaaggtgtaacttagtattccctgggaaagggactttctcctatagaatcccaaggtaatcttgaacagattacgttatcttgtcttctagttcatttaaagtgatggcaaatgtccctcaatgactttgggatgtgacatctcccggtagaagcatgtgcactacaggtaaacttgtgcagccctggtctgagctgggcagctggagacacagcccctgggtgagttctgagctgccctgggcccttcacctgggcacaccctgccccgcccctgtggatttgcatgtccccagagcaccgcccacctctctgggcatttaggagcaggctgctcccgccccatgcaggaggcagtgccaggcaggacccagcatggacatgagggcccccactcagctgctggggctcctgctgctctggctcccaggtaaggaaggccagcagcaggaacggcctcgggcagtgtggccagggctgcctgtctctgcaggagcgtcctcttagaacgtgaggatgagtgtggtctctgtgtttctgtttcctcctcagg

SEQ ID NO: 136 - DNA, 5704 bp, Oryctolagus cuniculus
ccacagtgttccaagccctaacaaaaacctcccaggaaagcagaagtgtgaggctggactgtcccagctgcccctcctgggccccatctgctgagagtgattctcagagcagccaggcttgaaggtcctgcagggtcgggtggaaggggccagggtgactcctctgaggctccctccttcctcctccttggcagcatcagcacagtcatggtcatgaaatactattttaaggagagcaattattttactggagacttgagtgtatagcatcattttggtattgcatgtaaaggagaaaataatataggtatggctagcaaaaatagtttaatcaaggtgagtgcagtcttccatgccctccatgtcctgggagaacggccttcagagagggagatcatagacacagagactctcagatctctcctagaggccaagcacctctggggcagaaggcacaggtgctgccccgcgtgtcctcagccctgtccaggaagccctggagtggggtcattggtgctctctctgcctgcagcactcacaggggattctcccccgcccctctgttcctggctctgcctgcaggagctgattgacaggtgggaattctgcttgtctcatagtgaaatctcagagtctggatggtttctctagagtgcaaaggtgcccaattatgtggacttgatccaacccaattctgtgcatctttctgtattttccttccacgtagcaatgttccctctatagaggaggccctggcttgcacagcagggccagaggcacaaccaggatggtgtgagatgccccgttcactgcacccctgcttcagtccatgctgacccacacctgtcatgcagctccttctgcagtatggtcaccaaacacagttctctcacaagcatttcacaccgctggtgacgttgtttcagattctgggaaagtaagagaagtcgtgtttcctatccttcctcatctcctctttcccttctcatcctgaggtcagtgctgccctctcacggtcaccgtgttctaatccctgcccccggtatggaaacagatacacagatcctaagctcttcttctctcaggttcctgcttgcgagccccctgccgtcacataccgagactgaagagagatcatccaagtgtttcacccagcagatttgtatctaagaggaatgctgtgccaactcccctcacaataaactgctgtttgtctcttgtcaagacacccaatgggagcaaagtgaacactttgaaatgtcagagcagtttagggaggaggtgaaaggcgttatcttccttggtgtttgcttggtgaattgttgctgtaatgaattattccattctctttggctcagacaactccaggtatgttgtgtggtcaggagctcaggtctccctggagttaaccctggaggcagcagggctgtggtgttctggaagctctgagcatgcgattccatttatcccccttttaaaaggtataaacacaaaaaaaccagcgttacataaggatggaaaaggagaaaatatgcttgctgtaactttgtcttcccatttaagttacccagttgtgaagtcttatttgaattcaactcaccacagaccatttttttagctcaattatttcatttaatctaatagcacacatgtttccagaggcctcttccaagcacattttaggcacagaaatgcagagagtatctccaaaaatactgtatggagttctcaccacatagactctgttagatttgcataatgtaggctgtttctttgtatttgtgtattgcatatgacctcttttttttttttttttttgacagctaaacccatctttgaaaacaagtcacagacagaaaaaaaaaagtataagtccttgaagactcctgagatgttgaatgtggaggcagctccagactctgactggggtcaccactccttgagctcttctctaggtgacagctgcagagaagcagcctgcgggtgttcctaatgcttcgtgcacttacctctaagtctagagtaagccccagtgagacatggaaatgcatatagaactgttagctcttacatggatttattaatcaagttacatgagtttacttactttaacagaggcaaaatatccattttttgtccctttaatttaaaagattcatttatttatttgaaagttaagagtcacagagaggcagaggtagagaaagcgtgagagtagtcttccatctgccggttcactccccgatggctgtgactgggggatctgccccatccaaagcctggatccaggagcttcttcctggtctcccacaagggtgcagggccccaaggacttgtgccatcttccactgctttcccaggccatagagagagatcaattggaagaggagcagctgggtctagaaccagaacccatatgggatgccagcaatgcaggcaacgccttaacccacctcaccacagtgccggtccatatcttcattttttaagaggtttatttttttattttaaggtcagtgttacacacacatgcaaacacacaaacacaaaaacacatacacacggggtgggagaatcttccatctgctgttacactctgtaaatggctgcaacggccaagactatgtcaggccaggctaagaaccagaacttctttcaggtctcccatgggtgtcagggcccaaacacttgggacatcttcagctgatttcccaggccgttagtatggagctggattggaagtggagactccaggaccccaacgggtgcatatgtgggatgctggcagtgcaggggtggctttatccactacaccacagtgctgcctgtcatatacacattttgagaattcatgatactttgagccatactctccttccttcctcactcccaccctactgctcttctttttttgtttttttaatattttcaatttagtttgatggcatactttcaatgtactttttaaatactagctaagccttccactaaacaaagaattcagcgaggagtgagcagaaaaaccactgttcctccagagtctagacaaggctgagagtctcagtcctcccaatccctctgtcactaccagacctgaggagcactggcgcccccgggggtccatgatggaatcgcatcagctttcaatccctgatagggcagtttttcattcaatgcaaaatcagatagacagttctcatggaaatgaaacaatagtggcttcattgtttgtacacaatgttacaaaactgacagtatcacaatcttttctagatttagaaaaaaggacaagaaatccaacagagctctttaacccatagatctttttatagttatcagggcaaataagcaaacatatattttataccttcttccactatgcttcaagtgagatcctccctggacactgccattgctgggggcacgtgggcagtgggtgtccaggtccacctagtgcattctcctgtctcgggcacaggcagagggagaggcagagaggacgaatcgggcagttccacactgtctttcctgaaaagatacactaattgtagtctcagtaatggtcagatggccaaatagttcttcgattgagggaaaagcttcttaaatttctcaaattggtgaggcatgaaaccagccaacacagaggtcagtggaagaatcagtgcccagacactggatgtgaaaataatggagcccacggcactgcggcacagcaggttaaagccatggcctgaagctctggcatcccatagggtgcaggttcaagtctcagctgctcctcttttgatgccgttctgctatggcctaggatagcaatagaagatggcccaagtctctgggcccctgcaccaagtgtgagaccgagaaaatctcctggctcttggtttcggatccacgcagcaccgctgttgcggccatttagggagtgaaccagcagatggaagacctctctctgtctctacctttctctgtaactctttcaaataaatgaaataaatctttaaaaaaaggagcccagttttagcagggtgttttgtactgcggtgaatacttatttctaataaatgtaatttagataattttcataaatgttaacattttccatgtttcaaaatatttatttattcacttgtaagtctgagcattggagagaggcaaagaccgggcggggtgtctgtaagtggtctctccacaaatgactgtaacagtgagttcctggccaagtagaagcccagagccagaactgcccctggtctcccctgtggggcaggaatccacgaacttggtccatttcctgctgcctcccagggtgagcattagcaggaaatgggatcagaagtggagcagtaggattcaaaccagtctctgatgtaggctgctggcattgcaagtggcagccttacccactgtgccatgatgccagccttccctcctctccggatttctttctttctttctttctttctttctttctttctttctttctttctagacaaatttacagtgagaggcagagaaagagaaaggtctcccatcctctggttcactctccaagtggctgcaatcctcagagctgcgctgatccgaagccaggagccaggagcttttctgaatctcccaatgggtgtaggggcccaaggtcttgggccatcttctactgctatcatcggccatagaggagtgctggatcagaagaggagcaggtgggactagaaacagtgcctatatgggaagccagcgcatcaggcaagtgcattaacactctgccatagcacagcccccctctctggatttcttaagaaagtgtggacatttctggacaggggagggaggaagtgtttctcagatctctggtgactccttgaaactcgcacttctgttttcctcttgcatccttgactcagaactctggctgcagatgggagagcgcacacgtgtgatctctcctctaagcacctgtgttctccttctgagtccagtctctggcagccgcttgttctgaggatgtttattctgagtcagtacagaggtgagtgtggacagaagtctcgtctctcagagaccatctccctggtgcagcggtctgccgtgaggggacaatgtgagggcatcagaggaaaaacaagaaaagacaatgacctcagttttaagatgtaactaagtattccctagaaaatggactttctcctaaagaatcccaacataagcatgaatacattacaccagcaggtcgttcagttcaccaaacgtttttgaaattatctctcagtgactttaggatgttgcgtctcctggtagaaacatgcgcactgtaggtaaacttgtgcagccctggtctgagctggggcagtggagacacagcccctgggttgagttctgagctgccctgggcccttcacctgggcacagccctgccccacccctgctcatttgcatgtccccagagcaccgcccacctctctgggcatttaggagcaggctgcttcaccccatgcaggaggcagtgccaggcaggacccagcatggacatgagggcccccactcagctgctggggctcctgctgctctggctcccaggtaaggaaggccagcagcaggaacggcctcgggcagtgtggccagggctgcccgtctctgcaggagcgtcctcttagaacgtgaggatgagtgtggtctctgtgtttctgtttcccttctcagg

SEQ ID NO: 137 - DNA, 10931 bp, Oryctolagus cuniculus
ccacagtgatacaagccctaacagaaaccccccaggaaagcagaagtgtgaggctgggctgccccagctgctcctcttgggccccatctgctgagagtgattctcagagcagccaggcttgaaggtccctgatgggtcgggtggaaggggccagggtgactcctctgaggctccctcctttcctcctccttggtggcagcagcacagacatgaccatgtccctactgttctaaaggaaaacagttattctttctgaatatggaagctagagcatcatttgggattcatacagcaagagagaaacattatagatattacaaggataaatattttaaatacaggtgattattacatttttataaagtatataaatttcatatgtacagtttttgtatgtgtagagttttttaaaatatttatttgcttattaaaacccgtggtttaacagacacacacacacacacagtggagagagagttctctttgatctgctggttctctcctccaaaggctacacaggctgaggctctgcctgtctaaagctgggcgatggaatttcttcttttttttttaagatttattttattgatttcaaagacagagttacagagagatgtgcagagaaagatgtcttctatctgctggttcactccccagatggctgcaatagccaagctgtgctgatctgaagccaggagccaggagcttcttctgggtctcacatgctggtgcaggggcccaaacatttgggccattttccactgctataccaggccatagcagagagctggatcagaggaagagcagctgggactagaaccggcacccatatgggatgctggcgctacaggccaggactttaacccttagcgccacagtgcagggcccgggagatggaaagtctttcaggtctcctatgtgggtgccaagactgaaacacatgttccagctgcctgctttggcctgggaaagcagtagaagatggcccatgtggttggtcccctgcacccacgtgggagacctggaagaagctcctggctcctggctttggattggcgccattctggaaattgtggccagttggggagtgaaccagcggatggaagacctctctctctctctctctctctctctctctctctgcctctccatcactctctgtgtaactctgactttgaaatacataaataaatctttttttttttaaaggtgcagggaagaagaaggtatgtattaactttcctttgtgggcttgagaacaatgagcccctatcacagcctcctaatggagtgcagctggagtgctcacaacagtcaagtcacatagagattctgtgcagccgctgtgctgggctttgcacggagagagcggtgtgagaagaggaaaagagctcagattaggagctgaagagcctggtttagtctcagcgctgctgagcgggagaagacctggtgctctggcctcctgttccctgtgtctaggtgggagggacagagggcttcccaggttccttttgctgtcaggctctgtgttatgggggtggaaaaggtggaggagcagtgttgctgggagctgcagagcatccgagtggacagcagcgggcggggaccccgtggttcagaagaaagcccatcttcagtttcccaccaggtgcccactgtcttttttcccatccactaacagcaaatgttcacaacaggaaagctgggtgtcgtttaccgattgtgatgaacgcatcgatgtgagctgtcagctggatgtgcagtggaaaggcactgtgtgtactgcttcacaattttttgatttgtaaatttaaagctattctgaaatggaaagtttctttacacaacaacacaacaaccacaaactaactgagtaccacagcaaacagtgaaaaagaaaaaaaaattccccctggcgtaattttagtgttcatattttcctgctgattgtctgccagaggctgatgggcatctgcaaataagaaatcagccctggaaagagtcttttaaaattgtgtatgtatttatttttatttgagtgggagagagagagggagagagatcttctgtccattggtttactcccccaaaggccaggctgaagccagtagcccaggactccacccaggcctcccacgtagatggcagggacccaggccctgagtcctcactctcagggtgcacatgagcaggaagctggcatcaggagcagactgggattagaccaggcactcagtgtgggatgtgagcaacccaagggccaggctgatgccgggggtcaggaactccatttgggtctatgtgggtggcagcagccaaagtacttgggccaccatatgccgcttcccaggtgcatgagcaggaagatgcatcagaagtggagctgagactcaatcccaggcactcaaatgtgggctgtgggtgttccaagtggcagctgaagactctgccacagcatccactctgcctaatttctattatttatttcctttcagtgttcttgagatgcactgttacatttttaatttgatgtctttctggtttttttttggatgtgagtacatattgcattaaacttccctggcacctggctttggcctggcccagccctggccattgtaggccatttggggagtgatttctccctctctctgccttcgtcactccctctctgtaactctacctttcaaataaattaattaacaaatccttgaatgaaaaaaaggtctgaggatgcagtttccctgcattcacttgctcaggggatactcccccccccccccccccccaggttggagaatcacagttcaagtttatccagctcttcagaccaggagtcaaacgcagagcagtctggatgggctgcctcacaagcgactgcccgcttccaggtttcacacgtttcttatggggtgggtgcatgcactcgtcaggtttaaacagcacggatttcagtgttgtcaatcacgtcgagaatccagcaggatactagaatagttaggatcttggtcatggattacgcaggtgcactgcgttcccacacttgatgttacctatgtgcacaaacagtgaggtcgtgcatcattttcccacgatggccctgggctgtgaagcttcctccccttagggcgcagcagtcccccgggtcacagagtttgctgagaagctgtgctccttgggggactgactgaaagcaagagtgtatcagattacattagtcccaaaagtccaggaggggtagagggctgatgatctgtctttagagctacttcctgctgacatggggtgatgaggtgctctctgctggcatggggcgatgtctcaagccgctgtctcctgggtggagagctgagtatatccctgtagcagcatttggttgaccacctggttgctgatggccttggttcgttcccttatcaactcctgtaaagacttaaacagacgcggtagtgtaaaagacagagtgagaataggaaccaatgatcctaagagtggcattaaccaggtaatgagaggtttcacagaggagaggaaatggggagggggctctggacccttgtgagacctgtttgatggacatggttcaaagctgatcccaagcaaccgggagaaaggccactcaacttttgcaggtagaggggtttttctgtagggaaattctgaacaatcatacaacatcaggtggtggagaggcccatcaatacacacaggtcaggagcaaatccattgatgttagagcagagactatgattataaaggaatgaggccccaagtgggctagatatggtctagaacaaaggacagagtcattactagaggacccaagagagctgctgtctaaaccatgactgagtttctgattgagaggcaaatagaaactgacagaaggggcttgaaaataatcaggtgggctttaaggccttgtcagttatgaggcccagatttatctatctcttcacatggggtacatcctaagggaggtgtgaacctcttggggaatgcaccctgttgacttccattacctagctggcctgggaggagagctggccgggtaaaggcaggtggcatccctaacaggaaacttacagttctgcctgcaatgttgctgaccttacttggctgtcccctcagcagtggtggtcactttggaagctgggctgagtgaagggctcttcagcttggagccagcaagatctggggctctgacctgggtgtccttcgactccagggcagttccatttccagagatccaactcttggctggcagagctgccagggctcttcctagctgacttctgctgaacccaggcttaccacactgaaagtcagtgcagtggactggcctgttgggtctccttgagggcatatcactgttcagagctgccacctctctttgcattgcttctgatgcctagctttcttttcctcctggtttttgttacagcagaccagaggatgcaagtcaaggaggtgctcatgtcccatctctaatctttggaggcctaaactggaaatctatggtcacaggcatgttctgatagtggttttccctgatgtagacaatgcacatgaggaaagctatgtcctcactttcaaactttctctccctctgtttggtctgaaagggacgttttgcctgtttactgtgcccatagcaaagtaaatctagctgtgaaattataatttaagctttccttttggctatgctattatggaaatttgttagccatcccttttataaggtctaaaaatcaaattgtgcatctaggagagtcctttggaatagaattagtttcctaccttgaagagaatagagaaaagagaggacaagttgggcttagaatagagagatgagggagcaagtcccagattgcttactgaccatagcattatcaaatgaaaacttagcaaagaatttcaaccattaaatgacaacttaggacaacatttaccagaaggtccaatgccttctataaattttaagaacacatgtatttggaaacatctcttaaatatctaacatggtgtagcttgtttaaccagcaaattcaagcacaaacatatagaaaccttcttagtttctttctaccaactaagttaaaatatctgatacagagattcaggtcacatggatcaaatgtatctttgattaattttatcagtttaaatttatggacgattttttatctgtaagccaaaaaataaagttcttaatgaattttcccatgtagacatacaatatgtacacacatataacaaaagagacagaacaataaaacaattttgacaattctttttaaactcttaattgttttttaggttaccaattgattcagattactttctgctcttagttgcctgaattaaccctgctttcttccaggtgggacctgtagtgcattattggcttcatctgtttacaaagccatcccaaagtactgaatacagcagagtggctgggaaaagtccatcagaacctatacaaaactgtgaatgacacaggactttaaatagccacgtttaaaattagaaaccatgaaccaacaagaggcagttgtgtccttcacacagtagttttgaaagcacctgtatggttttacagaacatttaagcttttaggcctctgggcctttctcattaatatagccatcatgtctagtaacacaagatcattggacttactaggacatttattaggacatttatatcagtagcattttatatgataaaacttaaaatttagcaccacttcacatgttgacagtacttctagcataatccaaatagcctgattagttggtctctctacaagatgagagacacatatcctttgatttttccagttggttgggcccaaactggaaaaatcgaagtccaactttattggaaatttcagagtccacattctttggaactttgattttggatttttggaatgcctgtcaaggatgccaagaaggcttaaagtatctggttgaaataagatccttcaccatcaggacataatgtagaccaaatttgattattgatataaggcgattattcaaatattttagaataagcatgtatttaaataacccacagctcttaatcaaaaactcagctgttttctaaacaattagaatttaacagaggcatcaagagaacataatagattacttttgatggaacaaggacataagcctcagccattctccctcactgcccaaaggagataaactttggaatatagtccttgcccttgaaactcaattgggtctcacaccctattgccttcataccccaccctgcattctttccaggttcccaagacccttccccgcctccagttcctggaattcccctccctgctgcctcctacctccaccccagccctagccctcctggcctggcatctgggagtcaaggccttctgccacatgcttcatcttgtacacgcaggcagttggttacccacctctgcggatttattttctctgaataaatttggtctgtctgtaaatttgtgcattgcctcttctctaatctgcaatggaggaataaccaagtgagtcatgtcactggccccttaaacccatctttaaaacataagtctcagccaaaaaaatagtgtaaggatttcatgaagactcctgagatgttgaatgtggaggcagctccagactgtgactggggtcaccactccttgagctcttctctaggtgacagctccagagaagcagcctgcgggtgttcctaacgcttcgtgcacttacctctaagtctagagtaagccccagtgaaacatggaaatgcatatagaactgttagctcttccatggttttatcataccaagatacatgaatttacttaatttaatgtaagcaaagtatacatttgttgtccatttttaaaaatatttatttatttatttgaaagttaagagtcacagagaggcagaggtagagaaagaatgagagaggtcttccatccgctggttcactccacagatggctgctgttgggagccactgtgctgatttccctgttttgagtataggcctctgtttagattaacctttagctgtgttcctgtaaggaggaagcactagaaaaattcattagtacagatcactgatatggttggcgcttggccctctggcttcagtgctctcctgacctcatgaattcttgtaccttgataagcacgtctggtagctgtaagaccccgtggtaactccctttgtcaaattgatgctgatttaagattcctgtaaaactattcctttgaactatgttgtaagatgacccctgcttgccctcgacggttacaatccttgccttgtagtatataagctacctccttctccaataaagtgagaccttgatcagagtcatgtcttggtctcccttctcgtgtctggtttgtctctccattcaggtctgccctcctcatgtcctagttgattaccccgtgggcaggggcagctgcaactgggggatcagtcccatccaaagccagaatccaggagcttcttcctggtctctcacgagggtgcagggccccaaggacttggaccatcttcctctgctttcccaggccatagcagagagctgaatcagaagaggagcagcagggaccagaacctgcacacatatgggatgccggcaattcaggcaatggcttaacccaccacaccacagtgccggccccagcttcatttttttgagatttatttgcttatttgaaagtcagtgttacacacatgcacaaacacacacacacacacacacacacacacacacacacactggtgagtgagaggagatatcttccatcagctgttacactctgcaaatgcctgcaatggtcaagactatgtcaggccaggctaagagccagaacttctttcaggtctcccacgggtgccagggcccaaacacttgggacatcttcagctgatttcccaggccgttagtatggagctggattggaagtggagactccaggaccccaacgggtgcatatgtgggatgctggcagtgcaggggtggctttatccactacaccacagcgctggctgtcatatacacattttgagaattcatgatactttgcaccatactctccttccttccttactctcaccctactactcttcttctttttttaaattttttgaattaagttttacgacatactttcaatgtactttataagcactagctcagccttccactaaacaaagaattcagcgaggagtgagcagaaaaaccactgttcctccagagtctagacaaggctgagagtctcagtcctcccaaccctctgtcactaccagacctgaggtgcactggcgcccctggtggttccatgatggagtcgcatcagctttcaatccctgatagggcagtttttcattcattgcaaaatcagacagttctcatggaaatgaaacaatagtggcttcattttttgtacacaatggtgcatgactgacagtatcacaatcttttctagatttagaaaaaaggacaagaaatccaacagagctccttatctcatagatcatttttagtgatcagggcaaacaagcaaacatatgttttacacctgctcccatgtgcttcaagtgagatcctccctggactctgccattgctggaggcacgtgggcagtgggtgtccaggtccatgtagtgcatcctcctgtgtcaggggcagaggcagagggagaggcagagggaacaaatcgggcagttccacactgtgtctcctgaaaagatatactaattgtagtctcagtaatgctcagatggccaaatagtccttccactgaggaaaaagttttttaaatttctccaattgctgtagcatgaaaccagccaacacacaggtcagtgcccagacactggatgttaaaataatagatcccatggtgctatggcacagtgggttaaatccctaaccaaagcatcagcatcccatagggtgccggttctagtcccagctacccctcttttgacccagctctctgctctgcctgggaaagcagtagaagatgttgcaagtccttgggcccctgcacccgtgtgtgagacccagaagaagctcctggcttttggcttcggatcggtgcagctctggctgttacggacatctgtggagtgaaccagtggatggaagacctctctctctatctctacctctctctgtaactctgtctttcaaataaattagataaatttttaaaaaatagagcctagtttgagcagggtgtcttgtactatgatgaatacttactgctaagaaagataattttcataaatgttaacattttccatttttcaaaatatttattcacttgtaagtctgagcattggagagaggcaaagacagagggggtggggggttcctgtaagctggtactctccacaaatggctgtagcagtgagttcttggccaagcagaggcccagagccagaactgcccctgggtctcccctgtggggcaggaatccaagaactttggccattttctgctgcctcccagggtgtgcattagcaggaaatgggatcagaagtggagcagtgtggattcaaaccagtctctggtatagagtgctagcattgcaagtggcagcttaattcactgtgccatgatgccagctttctgtcctcatcagatttctttctttttaaatttatttttaagacagagttacagtgagaagtagagacagagagagagaggtcttccttccgctgtttcattccccagatggctgcaatgcctggagctgcggcgatcagaagttaggagccaagagcttattccaggtctcctacgtggagcaggggcccaaggacttggggcatcttctactgccaacccaggccatagcagagagctggatcagaagcagagtagctgggtctggaaccggaacccatatgaaatgccagcactcaggccagggtatttactgattgcaccacagaactggaccctctttggatatcttaggacaagtgtgaaaatttctgcacaagggaagagggaagttatttttcttgatgttcctcagacctatgttgactccttgaaactcacagttctgttttcctcctgtatccttgactcagaactctggctgcagatgggagagcgcacatgtgtgatctctcctctaagcacctgcgttctccttctgagtcctggtctctctctggcagccgcttgttctgaggatgtttattctgagtcagtacagaggtgagtgtggacagaagtctcatctctcagagaccatctccctggtgcagcggtctgccgtgaggggacaatgtgagggaatcagaggacaagcaggtaaatacatggacctcagctttaaggtgtaactattccctagaaaatggactttctctaatagaattccaacataaccatgactggattacaccctcttgcccaccagttcagttaaagcgttggcaagtgttcctcaaggaatttggaaggtgacgtctcccgatagaaagaagcatgtgcactgcaggtaaaattgtgcagccctgatctgagctggggcagctggagacacagtccctgggctgagttctgagctaccctgggcccttcagctgggcacagccctgccccacccctactgatttgcatgtccccagagcaccgcccacctctctgggcatttaggagcaggctgctcccaccccatgcaggaggcagtgccaggcaggacccagcatggacacgagggcccccactcagctgctggggctcctgctgctctggctcccaggtaaggaaggccagcagcaggaacggcctcgggcagtgtggccagggctgcccgtctctgcaggagcgtcctcttagaacgtgaggatgagtgtggtctctgtgtttctgtttccctcctcagg

SEQ ID NO: 138 - DNA, 3985 bp, Oryctolagus cuniculus
ccacagtgatacaagccctaacaacaaccccccaggaaagcagaagtgtgaggctgggctgccccagctgctcctcctggccccatctgctgagagtgattctcagagcagccaggcttgaaggtcctgcagggtcgggtggaaggggccaggctgactcctctgaggctccctcctttcctcctccttggtggcagcagcacagacatgaccatgtccctgctgttctaaaggaaagcaattattcttgctgagtattcaatgttggagcatcatttgagattcatagagcaaaagagaaaacattatatgtattccaatcaaaatgagtttaaatacaagttattatataaattctataaagggtatcaatttcatagctacagtttgtacaagtttatttgtttatgaaagtctctcctaaacacacacacacacacacacacacactgagaagagagagaaagaaagatagagtgagagacagaaagagagagagagagagagagagagaaggaatgagactttgagctggaaaatttttttccgtcctctggttcactccccaaatggctgcagtggccgagcagcacctggcagaactaggatagaactcctttcattctcccacatggtgccggagctcaaacacgtgggccagctgcaggtgctttccaggacaagcagggagctggattggaagatgagaagcctggactcccaccggggcccatgtgggatgctggcgctgcatgaggttcttctcccactacagaggttcgacccaatctatccaaagttgtgagagcataatgccacttcccaccatgtcctccctcattcctcactcccacccccactcctcttctttttcctttaagtttacactgacatacttttgacttacaatcaccagcttaaccttccactgaacaaaattcaacaaggagtaaacagagaaatcactgttcctctagagtctagacaaggttgtgagtccccatcctcccgatgcctctgtcactaccagaccaaaggtgcactgccgccccctgggggtcataggtggaatcacatcagttttcaatccctgattgggcagttcttcattcaatgcaaaaccaactggaacattctcatcaaatcaaaccaatagtggtgtgagaggccagcgccatgccattacaggcttctcacaagacaaaggaaccagctaggcctaggatgcacctgttgcagggagaccaaacctgacactgggcagtccttggtccggcagggtcaggtgggggaaaccaatgaggtgggctgtccttggcccagcagagccaggtgggggcaaccaatgaagtaggtgggcttgatgtatggtcatatggggaaagaaggaatacagatataatgcttgtttgtctggtaactataaaaaccccgggaacaaagtaagtgggtcttggtctcccagccctacactgcatgggaggccaggccccagtatgctggacctgtaataaagtccctttgttctttgcattatggtgagtctcgctggttctttctatctgggtgtccgggacacaacagtggcttcatcattcctacacagtggcacatgactaacagtatcacaaactcctaggcatagaattactataaacacttggacagagcccttcatgtcatagatctttcattttagtggtcagggagataatacacacacatagaaggttctccacctgctccccctcttctgcatgtgagaggcctccctggggcactgccgttgctcagggcaagcgggcagtgtgtgtccaggtccacttagtgcatcctcccatctcggggcagaggcagagggaacgtatcgggtggttcaacatttgtgtttcctgaaaaataaaataactgtagtctcagtaagggccagacaaggaaattgtcctttgattcaggaaatagctttttaaatttcttaaatcgctgaggaatgaagccagggagcacacaggtcagtggaagaatcagtgtccagacactggggataaaaaagaggaacccagtttagcaaggtgtcttgtacagtgattaatatttatttctagtgaagataattttcttatgtgttaacactttccactttccataacattcctttatgtactagaaagactgagcattgaagagctgcaaagtgagagagactgagtgagagagagagagagaaaaagaagaacttccaggtgctgctatttcctaggagatcccatcagccgaggctgagtgaggctgaagaaaagagcacaaaactccatgtaggactcccagtgtgtggcaggatccaagcacagccagttttataaatcatggccatcgccatgttttctattcattgctctattaagacaaacgaatgccattaggggataagagaaagcagaagccgccctggcctcagtgacgtccaccagaaccacaccgaggagctgctcagcttctccaggttctgggctgtgcaagccctgcagcccctgtcacaggtggagcagcagcaaaaaagctggtctgagccgtgaggagagcgtggacctctacccacactggtcctctctctgcttagaccccagagagacattcactgtaggagacctgtgcaacctgggtctgattggacacctggggacatggcacctgtgtacaggtgctgagggattggagagaattctcctatctgattgtgcatctcagcagggagggttggttgcccaaagtcccacggtgagccggtgcgggtgctgggatttgagctcaggtctctataaccttaaatccattcctaacacatggccaagttcatcccgtggctgaggccagagtataaaataacacaggataccagcccaggatggggtagaacacaccgctcctcactgtctctgcctcactccaaggggacccatatcttccacccagtccctcctacagctgtgcccccgactgccattctctcagagcctcctcaaccccaggggactgcatgtcagtgtggggcaaggcctcctctgcatcccagactctttcctctcctcctccgtcccttctcatcccttctctcatcctacctctcatttctctgcaacaacaatttctcacctccgtgcagatagagatcaaacaatcaaagcctcctcctccactcttgtcttttgataggtgaccctgtggctgtcacatacctacactgacaggaggtcatcaagatacttacccaacacattctctctcagaggcactgtgtgctcgctcagcttacagtcagctgttctctgtgtgctgtagaatggaccccacgtgagaacacagtgacactgggaggatgtcagagcccagccactcactcaaaagggaaaagacactgacttcaacttccaaggtgtgaacaggtgttctcaagagaaaaggactttctcctacagatccccacctaaccatgaatagattacactaccaggtcgttcagttcgcttaaagtgctggcaagtgtcccacagtgacgttgggaggtgacgtcttccaaaggaaacatgcacactgcatctaaacgtgtgcagccctggtctgagctgaggaagctggagacacagccccggggctgagttctgagctttcctgggtccttcagctgggcatagccctgccccgcccctgctcatttgcatgtccccagagcaccgcccacctctctgggcatttaggagcaggctgctcccgccccatgcaggaggcagtgccaggcaggacccagcatggacacgagggcccccactcagctgctggggctcctgctgctctggctcccaggtaaggaagaccagcagcaggaacggcctcgggcagtgtggccagggctgcctgtctctgcaggagcgtcctcttagaacgtgagaatgagtgtggtctctgtgtgtctgtttccctcctcagg

SEQ ID NO: 139 - DNA, 6632 bp, Oryctolagus cuniculus
ccacagtgatacaagccctaacaaaaaccccccaggaaagcagaagtgtgaggctaggctgccccagctgctcgtcctgggccccatctgctgagagtgattctcagagcagccaggcttgaaggtcctgcagggtcgggtggaaggggccaggctgactgctctgagaccttggtggctgctatacagaccaggtcaaatacaactatttaaaggaaagaaaatattctactggagtatttggtatatactatcattttggattcatagagcagaagagaaaaatattatagaaatggcaagaaaaatattttaaatcaaggtgagtggagtcttcgcatgccctcaacgtcctgggagaacggcagtcagagagggagatcgtagacacagagactctcagatctctcctagaggccaagcacctctggggcagaaggcacaggtgctgccccgcgtgtcctcagccctgtccaggaagccctggggtgggggcgctggtgctctcactgcctgcagcactcacacgtgattctcccccgcccctctgttcccagtttgcctgcaggagctgattgacagaggagaattctgcttgtctcatggtcaaatctcagcgccatggatggtgtgtgtgtagtgtgcaatggtgtctgaatatgcaggcgtgattctacccaggtctgtacatctttctgtatttttcttccacgcagcagtgtttcctctatagaggaggccctggcttgcacagcaggacccgaggcacaaccaggatggtgtgaaatgcaccgttcactgcacacctgcttcagtccatgttggctcaaactgccatgcagccccttctgcagtttggtcaccaaacacagttctctcacaagcatttcacaccgctggtgacgttgtttcagattctgggaaagtaagagaagtcgtgtttcctaaccttcctcatctcctctgtcccttctcatcctgggtcagtgctgcccctcagggtcaccgtgttctaatccctgccctcagtatggaaaccgatacacggatacaaagctcttcttccactcaggttcctgcttgggagccccctgccatcacatactgagaccgaagagagatcatccaagtgtttcacccagcagatttgtatctaagaggaatgctgtgccaactcccctcacaataaactgctgtttgtctcttgtcaagacacccaatgggagcaaagagaacacttcgggatgtcagagcaggatcagggaggaggtgaaaggtgttctcttccttggtgtttgcttggtgcattgttgctgtaatgaattattccattctcttcggctcagacaactgcacgtactgttgttgtggtcaggagcttaatgctgtcgctgtaagaaactccgggggcagcagggctgtggtgttccggacgctcccgagcatgggattccattccaggtttgtgcagcgtcaggatggccacatttcctgctctgtggcccctcctccctcactccacagcctgctgccctgtcacagcccctggaccctagccctcctcccgacttcaggaccattgtgatagtatggatcccaccaggtccttctgggacatctccccaccacagtccattgcctaaaatctccattatgatgcggcacctgggggaagttccaggggagtgtctggctgccagggttaagctacctaagatcagaccaccagcagggatcggtcagctttagttcaggacacgtggacagtgtgtgatccctatactttgcttaaggtttgctgtgtgtgctccacgcgcctgcatgacctttctgctgattggctcccctaccgcacatatcttttgtaagctttataagcctgcattcttcttcaataaggcggttcctgcttcgacagaactcacgggtgcttgtggtgtgttcatcacctgtcgaccttacctctcccgttcgccttttggggagtgcctgcgctgcccctgctggtcagggctagcatcgggcttgagaccccgacacccatctttaaaacataagcctcagattaaaaaaaatagtgtaaagatttccttgtgtggggaatcccacaggagtcccaaagacgagccatggatcaccgcttacccaacaactaataggaggtagaccgtggagaaattcatggtagtcccaaatgagtcacacagcaccgctaaccacaaatcaactaaaacaagaatggagttactgatgccaagctaggagctgatgacaccacgtgtgctaagtttagtgtctgccaagaaaagcctctcctcatcagactgaacagacgccccggacagtctgacactgtgtgtgctaagacggtaacctgaagtcccccaacaatagcatggtgactcacagcaccggacacagctgatcctcccggtcttacacagcagatcagtggtgccccgggaaattccagaacgtgactgattgactcccagacccccaccaggggcctttccccctggagtggcaaggataaaaggagagctcttttcactgctccccaccccctcagggatcatggcccagtacgtgggaacctctggatctcctggtatgtggagctgaaaagccagctcactactctgtagcggcacaaagcgactacgggaccaacctccatcggagccgacacctcgccacctctcatcagcctgctgctggaccggacagcagagctggaccagaactctcagcaggagacctctccaactcctcgccttgccggctgcctgggaacttggagcctactgcccagagagacagtcatcccacgacttcctgcctgtgactgttctgagatccgtttcttgagtgctaacggagacttcggactttgacttcctgaccctgatacaaaccttgagaatgtgacatttataatgatattagccacgtggaatatgaaggaatgtgcctctaccgcatgattaagaatactgccatatgcctgccgtacttacatccctatagttggattgccttagagactgcctttatgatgtgtgttaggatctgtggattaatgaatataactatatagattggtatgcagagtggtgaagccctagtgtgaattggtgtgaacaataaaaacctttcattggaaagacagtcttgtgtccacgtgttccttcttcccggtactccgacacttcgcccttaagccctgtcgagcggcatgacagtaggtgctcacgacaccttgaaaactcctgtgctggtgctggcactgtggcttggcggcagccacagtgctggcatctcatatgggtgctggtttgagacctggctgctcaacttctaatccagctccctaatatgacttgagaaagcagaggaagatggcccaagtccttgggcccctgcacctgcatgggagacctggaataagctcctagcttcttgctttggattggcacagatctggctgttgtggccaaatggggaatgaaccagcagtataggtgatagctccagagaagcagcctgcgggcattcctaatgcttcgtgcacttgcctctaagtctagaataagccccaatgaaacatggaaatgcatacagaactgttagttcttccataattttattaatcaagttacatgaatttaacttattttaatgcaggcaaagtatccattctttgtctatttttaaacagatttatttatttagctgaaagttaagagtcacagagaggcagaggtagagaggcagagatagagagagacagagagaggtcttccatccactggttcactccctggatggctgcaactgggggatctgccccatccaaagccaggagccaggagattcttcctggtctcccatatgggtgtaggggcccaaacacttgtgccatcttccactgctttcccaggctttagcagagagctgaatcggaagaggagcagctgagactagaaccggcacccatttgggattccagactgcaggcagcggcttaccccaccacaccgcagtgctggcccctagtttcatttttttaaatatatttatttgcttatttgaaagtcagtgttacacacatgcacaaacacacacacacacacagagagagagagagaggagagatggagagaagagagagatcttccatctgctgttacactctacaaatggctgaaatggccaagactatgttaggccaaggctaagagccagaacttctttcaggtcacccacgagtgccagagcccaaacacttgagatatcttcagctgatttctcaggctattagtatggagctggattggaagtggagaagccaggactccaacaggtgcacatatgggatgtggctttatcaactacaccatagtgctggctgtcatatacacattttgagaattcatgatactttgagccatattctccttccttcctcactcccaccctactgctcttctttttttttaatattttcaattaagttttacgacatactttcaatgtactttataaacactatctcagccttccactaaacaaagaattcaatgaggagtgagcagaaaaaccactgttcctcatcctatagacaaggctgtgagtctcttcctcccagtccctctgtcactaccagacctgaggtgcaccggctcccccagggggtaacaggtgaaatcacgtcagctttccatccctgatggagcagttcttcactcaatacaaaatcaatagaaaattctcattgaattgcaccaatagcagcctcattgtttgtatccatctgcacaaaaataacagtagcacaactttaggcatagaagaattggggcaagtcaggcagggcagataataaaccaatgacgttctacctctgctccctctcggctccacggtagaggcctcccctgggcagcacgattgctcaggacaaggggcctgtgggtgtccaggtgcatttgtgcatcctcagtctcaacctagacagggactgaggcagagaaacgtatcagtcagttctacacttgtgtttccaggaaaaagctaaggtgtggtctcagtaatggtcacagagccaaagcatcctatgattgctgaaaaagtttttcaatgttcacattcctgtagcatgaaaccaggcaacacacaggtcggtggcaagaagcagtgccctgacactggagctaacaacaactggagcccagttttgagagggcgtcttccactgtggttaacagttatttctagtgatgttaactttcttccatggtaccattttctatttttcaaaatatttatttacctagaacccaagcattggagagagacaaagaccaagagagattgagaggaacagagaagaaaggagagagagagggagagagagagagaagacagtgagaaggcaagagagatagagataaatatgttctttaacctggtgcactctacaaatggctgtaacagtgggttcctggccaagcagaaggccagagccagaactgtccctggatggtgcaagaatccaagaacttgggccattttctgctgcctcccagggtgggcattagcaggaaatgggatcagaagtggagcagtggggattcaaaccagtctctgatgagggctgctggcattgcaagtggcagccttacccactgtgccctgatgccagccttccctcctctccggatttcttaagaaaaacctgaagtgttccagaaaggggagagaaggaagttatttttcatgatgttcctcaaaccattggtgactccttgaaactttcacttatcttttcctcctgtatcctgactcagaactcagctgcagaagggagagcgcacctgtgtgatctttcctctaagcacctgcgtcgccttctgagtcctggttctggcagccacttattctgagtcagtacagaggtgagtgtgggacaagagtctcgtctctcagagaccatctccctggtgcagcgggctgccgtgaggggacaacatgagggcatcagaggacaaacaggtaaagacaatgacctcagccttaaagtgttcactattcattagaaaagcaactttctcctccagaatcccaatgtaatcatgcgtagataatgctatcttgtcgtccagttcatttaaggttgttacaagtgtccctcagtgactttgggaggtgacgtctcccggtagaaacatgcaaactgcaggcaaacttgtgcagccctggtctgagctggggcagctggagacacagcccctgggatgagttctgagctgccctgggcccttcagctgggcatagccctgccccgcccctgctgatttgcatgtccccagagcaccgcccacctctctgggcatttaggcccaggctgttcccaccccatgcaggaggcagtgccaggcaggacccagcatggacatgagggcccccactcagctgctggggctcctgctgctctggctcccaggtaaggaaggccagcagcaggaacggcctcgggcagtgtggccagggctgcctgtctctgcaggagcgtcctcttagaacgtgaggatgagtgtggtctctgtgtttctctttcccttctcagg

SEQ ID NO: 140 - DNA, 4214 bp, Oryctolagus cuniculus
ccacagtgatacaagccctaacaaaaaccccccaggaaagcagaagtgtgaggctgggctgccccagctgctcctcctgggccccatctgctgagagtgattctcagagcagccaggcttgaaggtcctgcagggtcgggtggaaggggccagggtgactcctctgaggctccctcctttcctcctctttggcagcagcagcacagccatgaccacgtccctactgttttaagggaaagcaacttttctttctgagtattcaaagctggacatcagttgaaattgatagaaccaaagagagaacactacaattattacaaggaaaactattttaaatactggtgattataaaattttataaaggaaaccaatttcatatctacagtaatttaatgaatttcatttgctttttgaaagtccgtgttttacacacacacacacacagacacacacacacacacccacacacagagtttcatagagagagagagtcccttccatctgctggtctctcctccagtggctgcagtggctgaggcagtgcctggcaagagctggagatggagcttctctcaggtctcccacacgggtgccagggtccaacactggagccatctacaggagctttcccaggctaagcagagagctggattggaagtggagcagccaggactcccacaggtgcccatgtggatgctggtgctgcctttggctgctttgcccactgcacaaggctggcccatcctgtccactcttgtgagaaataatgcctcttcccaccatgccctccctccttcctcactcccacccactcctctctttttcttttaagttttacatggacacacgttcaatttattaccaccaggttaaccttccagtaaagaaagaattcaacgaggagtgagcagaaaaccactgttcctcaagagtctagacaaggctgtaagtctcagtcctcccaatccctctgtcactaccagacctaggtgcactgcctccccctgggggtcacaggtggaattacatcagcttttaatccctgattgagcagttcttcacgcaatccaaaatcaaatagaaaattctcaacgatttgaatcaatagtagcttcattgtttctacagactgcatatgactcacaatatcaaatctcctaggcatagactgtttgtaaaaagctgagcagagcccttcatctcataaatctctcattttgtgggcagggcagatatgcgtggctcactaggctaatcctcctcctgtggccccagcacaccgggttctagtcccggttggggcgccggattctatcccggttgttcctcttccagtccagctctctgctgtggcctgggagtgcagttggggatggcccaagttcttgcgccctgcacccacatgggagaccaggagaagcacctggctcctggcttcagtgcgctggtcgtagtggccatttgtgggttgaaccaacggaaggaagacctttctctctgtttctctctctcactgtctaaatctgcctgtggaaaaaaaaagaaagaaaaaagaaagaaacatataaggtttctatacctgctcccactctgccccacatgagattcctccccaggggcactgccattgcttgggcaagtgggcagtgggtgcccaggtcctcacagttcattctcctctctcggggacagaggcagaggcagaggcagagggagggggatcttaccatgcagttcaacatttgcccttcatgaaaaaataaactaactaacagtaatggtcagatggccaagttgtcattggattgaggaaaaaggttttaaatttctgtaatcgctgaggaatgaaaccagccaacacacaggtcagtggaagggggcccaagctatggcctatcaggtatgctacacctgcagtgccagcatcatctatggggctggttcaagtcctggctgctccctcagatccagctctgtgctgtggactggggaagcagtagaggatggcccaagtccttgggcccctgcacctgcataggagatctggagaaagctcctggctcctgattccttgctcctggcttcagattggcacagctctgcccattgcaaccaattggggactgaacaaatggatggaagacctttctctctctctctctccctctctgcctctctgcctctccttctctctgtgtgtaactctgcctttcaaaatatatattcacttgaaagacagcattggtggaaaacaaagtgagagagactgagagggagatgagagagggagagagagagagagagagagagagagagagagagagagattctgtccattggtttactcccccaaaggccaggctgaagccagtagcccaggactccacccaggcctcccacgtagatggcagggacccaggcacatgagtcctcactctcagggtgcacatgagcaggaagctggcatcaggagcagactgggattagaccaggcactcagtgtgggatgtgagcaacccaagggccaggccgatgccgggggtcagggactccatctgggcctatgtggggggcagtagcctcctgaccacaaaagagcccagggccctgttaacaacttcctcaacctgcgtgcatgctcagaatagcgcaacatgaccaatatgtgaccttcctggggtcagcaacaccaccacttggagcgtgtcatgggcgagatagctaacagctcccacacagcgcagagctgggtgtacactgaactgttgtgggtcaagggagacgagctacaaccacaggctgggtcctgatctaggtgccgtgtgcctagagaaactgctgtgtctccaagtccgtagaatcaggggcttagctcccgtggggggaccagtcggaggactcctgcctgctgtgctcgctcccccgtgcacctgcgcaagaccacaggaaacctggtctgcactgcaggtcaccctcttggtaatttctattttcaagtgagtccaggaacctgggctggcaacaaaaccttatcacccatggcccctccttagaaactccaaaatattctgataagagaaaggagtgcagagaatccctgatgtgctggcgtctccagttggaatcaggtcatgaggctgtgccagcagagggaccccgcaatttgcccttcactcattccaggtgcctcacatgctccgcccacacccccaggcacagccctccgacttgggactttttaactcaaccttgtagagatctagggctcagcaccattgggcagtgcaggagcggccagggaatgtcactggtcctggtgcttgggcatccattgttctgtgtgccaggtgaggcgaatgagccaaatttcagaaatagaatgaatggttcttccagtgtgtagtgtctcgtgcttttgagatgtgacacaggataagcgtcccagcattgatgaattctacagttctggcattgaggagatgagttagtgttgttgtttttctttctttcttttttctttataaaccaactgcctaaccctacaggttcagtctgtctgtgagtgcaggtccgaggagcacattgatcttgcttgaactttaccattacagattgtgttcccagaggaagtcaacaacagcacccagctggtcggatgcaaaacccctactgtggtatcagcacctgcctggactgtctccttgctcggtcacagcatttgacagagtccataggctgcctatctctttaggagcctggactattcactcagaaacacactggaacctagaaaaatctgaaacccttagttctaagaagaggaacagagtgccaagctgtggcaggccattctcaggatcaagcaagaggagatggacttgatgtggggatttataaacaagtcattttagtaagaaatcatcatgtttatctagtggagaaggagacagtgaggttcaggttgaactcctcaagttgtcttttttctggtttgcatctggttcttgattcaagttggctgagagacagatattaccctctgcagggtagaagctgaaaatgttgtaggctttgctgtccctcccacagggactggggctaaggcagaaaccttccaggggaggcctgtggccagggctgcctgtctctgcaggagcgtcctcttagaacgtgaggatgagtgtggtctctgtgtttctctttcccttctcagg

SEQ ID NO: 141 - DNA, 3791 bp, Oryctolagus cuniculus
ccacagtgttacaagccctaacaaaccccccccccctccaggaaagcagaagtgtgaggctgggctgccccagctgctcctgggccccatctgctgagagtgattctcagagcagccaggcttgaaggtcctgcagggtcgggtggaaggggccaggctgactcctctgaggctccctcctttcctcctccttggtggcagcaacgcagacatgaccacgtccctactgttttcaagaatttgattattctttctgagtaattgaagttgtagtatcatttgagattcatagagcaagagagaaaacattatagatattacaaggaaatattttaaatactggtgtttagaaaattttataaaggataccaatttcatatttaaagtttttagtttttatagttacagttttttaaaatgatttatttgttattgaaagcacatggtttacacacagccacacacatacagagttaacagagagagttctcttccatctgcttgttctcttctccagtgactgcacctgctgaggctgttcctggcaagagctgggacgtggaacttctttcaggtctcccacgtgggtgtcagggctgaaacacttgttccatccactggtgtttcccaggccattagcagggagcttgtttggaagtggagtagcaggactccactggtgcgcatgtgggatgctggtgtggcatatggcagcttaacccactgcacaaggcctgcttatcctatgcacggttgtgagagcttaatgccacttcccaccatgtcgtccctcctttctcactcccaccaccactctcctttttttatttgtcttctctattttaaaatgacatacttttcatttacttataatcaccagcttcaccctccactaaacaaagaattcaacccggagtagcagaaaaaccactgttcaaatcactagacaaggtgtgagtctcttcctcccagtccctctgtcactaccagacctgaggtgcaccggctccccctgggggtcacaggtgaaatcgcgtctgctttgaatccctgcttgagcagttcttcattcaattcaaaatcaaatagcaaattctcatcgaattgaaccaatagtagcttcattgtttgcacacagtggctcacagtgaacagtatcacaatctcctaggcatagaagaattttaaaaatcgaacagagcccttaatctcctagatatctcatttcagtgggcagggtagatagtaaacaaacatcaccagctcccactctgggccctgtgagaagcctcccctggagcactaccactgctcgggtcaggtgggcagtgtgtgtcctggtccacttagtgcatcctcctgtcttgaggcagaagcagagggaatgaatccggcagttcaatttagtgtttgctgaacagaaaaactaatggtggtctcagtaatggtagaggaaactttgtcctttgtttgaaaaagaagctttttaagcttctcaaattgctgagtcatgaaaccagccaacacacaggtcagtggaagaatcagtgcctggacactggagatataaaagaggaacccagtttagcaagggtgtcatgtactgtgtttaatacttatttctagtgaagataattttcttaaatgttacccttttccattatttttaagatttattttatttatttgaaatatggagttacagagagagagagcgatcttccatcagttggttcactccccagatatgtgccatggccgtagctctgtcgatctgaagacaggagcttcttccgggtctccatcgtgggtgcaggggcccagggacttgggccatcttcaactagtatcccaggccatagcatagagctagatcggaggttgagcagagggactagaaccggcgcccttatgggatgggggcgcttcaagccagggcgttaacacactgcgccaccgtgccggcctcacccttatccgcttttgatatatttatgagagctgaacacagagttggagagagaaagagagagcgagaaagagcgagagagagcgagagagagagatcttccatgtgctggtctttcccagatgacccttacacctgggctggaccaggccaagtgcagagccgagacctccaccgtggactgccagtgtatagcagggatccgagtacagccgttcccctcgaagtgtgttctaactattgctctttcatatcacaccaaggccattagggaatgagagaaagcagaagcctctcctaccccagtgacgtccaccagatccacactgaggagctgctcagcttctccaggttctgggctgtgcaagccctgcagcccctgtcacaggtggagcagtagcagcaaagctgggctgagccgtgaggagagcgtggacctctacccacactggtcctctctctgctgagaccccagagagacattctctgtaggagacctgtgtaacctgttatgatgtggacacctggggacatggcacctgtgtacatgtactgagggattggagagaattctcctatgtgaccgcgtatctcagagggcaggatgggctgctctaagtcccatggtgagtaggtgcggagctgggatttgaactcgggtctctaaaatacattccttctacaaggctgtattcatgtcatggctgaggccagagttgaaaataacacaggatcaagcacaggatggggtggaacacacagctcctacctgtctctgcctactcaaaatctggacccacatcttccacccagtccctccttcagctgtgcccccactgccattctctcagagcctcctcaaccccaggggactgcatgtcagtgtggggcaaggcctcctctgcatcccagactctttcctctcctcctccgtcccttctcatccctcctctcatcctacctctcatttctctgcaacgacattttctcacctctgtgcagacacagatcaaccaatcaaagcctcctcctccaccctcgtcctttgataggtgaccctgtggctgtcacatacctacactgacaggaggtcatcaagatacttacccaacacattctctctcagaggcactgtgtgctcgctcagcttacagtcagctgttctctgtgtgctgtagaatggaccccatgtgagagcacagtgacattgggaggatatcagagcccagacactcactcaaaaaggaaaggacactaacttgaagttttaatatgtaactaatattttcttggaaaagggactttagtctacagaatccaaacataacattgaattaattaaaacaacttaccatccagttcactgaaagtgatggcaattgtccctcagtgaatttgggatgtgacatatcctggtagaaacatgcgcactacgggtaaacttgtgcagccctggtctgagctgaggcagtggagacacagcccctggcctgagttctgagctgccctgggcccttcagctggcacagccctgccccgcccctgctcatttgcatgtccctagagcactgcacacctctctgggcatttaggcccaggctgctcccgccccatgcaggaggcagtgccaggcaggacccagcatggacatgagggcccccactcagctgctggggctcctgctgctctggctcccaggtaaggaaggccagcagcaggaacggcctcgggcagtgtggccagggctgcctgtctctgcaggagcgtcctcttagaacgtgaggatgagtgtggtctctgtgtttctgtttccctcctcagg

SEQ ID NO: 142 - DNA, 6557 bp, Oryctolagus cuniculus
ccacagtgttccaagccctaacaaaacccccccaggaaagcagaagtgtgaggctgggctgcccccgctgcttgtcctgggccccatctgctgagagtgattctcagagcagccaggcttgaaggtcctgcagggtcgggtggaaggggccagggtgactctgtgaggctccctcctttcctcctccttggaagcatcagcacagacatgaccatgttcctactgttttaaggagagcaattattctactggagtatttgagtgtatagtatcattttgaattcatacagaaaagataaattattatagatatggcaaggaaaaacagattaaatccagatgagtgtagtcttactatagcctttaatatcctgggagaacggctgtcagagagggagatcgtagacacagagactctcagatctctcctagaggccaagcacctctggggcagaaggcacaggtgctgccccgcgtgtcctcagccctgtccaggaagctctggggtgggggcactggtgctctctctgcctgcagcactcactggtgattctcggctgcccctctgctcccagcttaacctcaggaggttattgacagaggagaattctgcttgtttcctggtcaaatctcagagccatggatggttggtccagaatgcaatggtgaccaaatatgttggcttgttccaacccaggtctgtgcatctttctgtattttccttgcacgttgcaatgttccctctatagaggaggcccctggcttgcacagcaggacccgaggcacaaccagggtggtgtgagatgccccgttcactgcacccctgcttcagtccatgttggctcacatttttcatgcagctccttctgcagtttggccaccaaacacagttgtctcacacgcatttcacaccccaggtgacgttgtttcagattctgggaaagtgaatgaagtcgcatttcctaaccttcctcatctcctctgtcccttctcatcctgggtcagtgctgccctctcacggtcaccgtgttctaatccctgcccccggtatggaaacagatacacagatcctaagctcttcttccactcaggttcctgcttgggagccccctgccgtcacataccgagactgaagagagatcatccaagtgtttcacccagcagatttgtatctaagagcaatgctgtgccaactcccctcacaataaactgctgtttgcctcttgtcaagacacccaatgggagcaaagagaacactttgggatgtcagagcaggatcagggaggaggtgaaaggcgttctcttccttggtgtttgcttggtgaattgttgctgtaatgaattattccattctcttcagtcacaatattgcatgttctattgctgtggtcaggagctcagcgctctccctggaagaaacccgggagacagcagggctgtggtgttcttgtatctctcgaggatgggattctgttctaggtttgtccagtgtcaggatggcagatttcctgctctgtggccccccccctccatcactccacagcttgctgccctttcacagcccctggccctcatcccgacttcaggaccattgtgattgtaccgctcccaccaggtccttccgcgtcatctcctcatcacagtccttaatcagccaccctgcccagccccttagatgacagacctggcgagaagggagtaggctgcagatggcttctgtgttggagacgatttgtgtctgtcttacactcttaccatctctgccactgtctcccctgagacagaattagagctgatggggtagatcttggcgcacagagttggaggagatctagaccgaggtgctgtgacctgtgtgttggagggggtggggaattttaatgctgcctctaatggggacttcatggagcccagctgcttggcagagtttgataaatgcagtgtggttttagaactcagaatctgatgagcgcccaaggaaagagtggttgttccccaggctcatgcctgctgtaagccagttggatgatgctcagttggggtctgtttttcagatttatatatttatttgaaagagagttagacaaagggaaaagaagcagagagagagagagagagagagaggtcttccatccatggttcactccccttttggccacaacggcctgggctgtgcagatccaaagccaggagccaggcagagttacagacagagtaagggatagacaaagtgcaaggtttccatctgctggttcagctcccaaatgttcccaatgcccagggcctgactgatccaaagccaggagccaggagtttcttctgtgtctcccatgcaggtgcagggacccaagcacttgggccctcttccactgctttcccaggccatagcagagagctggatgggaagtggagcattcaggatatgaaccagtgcccagatgggatgctggcactgcaggtgaggattaacctactttgccagagcgtgggcccctcaactgcacccttacacatcagcgacaatttgtaaacctagatgacttgtcacagaatccaggtgattgtgaacagaaaatttagaattttaattaaacctcctggaccacttctgaaagtacatgaaaagaatgaggagaaatgaggagataagcttgtttttctgcaagaaatttcaaaaccgtgcattattttttcattatatggattttccctgtcttttgaagattgcttgtgaatgtggcattcgttcatggaaggtgtgagtgctgctgggtagaacaaggacagcaggtgcacaccgctgtctctcagagtctctgatctctgtgtggaccccactcctctgggacaagcgaagcagcctcgggtcatccacagctgccctctgtggtttctctgcacaaacccatctcggagcacgaggccccacacacaggtcagtccctcttgtcacaattctgtagggctgtctctttgtgcttaaaaatattcaaattgcttttaaagctgtttatgcgacaactaatctggagcccatggtggggaaaacagtggaccggaaggcaggagaggagaagtctgaaaagctgaagcaatctggagccccagggtaacggaggggaatgttgcaggtgcagcactgggaagccatcagctgagaggacgctgagccctcccaacaaaacctacagagacctgcaggtctgcattggccacaggtgggcagacgtccaagacagcgtcagccacatgcgccagctgggtcaataagcctgcagagactgctccacctctggctgcaaacgccctctcaggagcagggcttgtaatgaagatgaagatggggaaccggagcagaggcctccaggagccaaggtgaggatgaggagccctggaaggattcgccagcatcagccagacacatccctgcaggagggaaagcacgggttttctgaggggcagaggctctgggagccagatatcaaacctcatgctggaaatggccgtgaccaagacaactgaatgacgcgttctgaaattggggatgggtgtagggtgggtgtcaagttgaaaggaacaggttccctttttgaagaatggtataaggcagtctctgaagctgctttgttttattctttttcatattttttaaagggtgtcaaaagggaacaatttcccttttgaaagaatggtattgttgtaccagctcgtcagctgaaatagagtattacaataccagtgacagtcacacaggaattttattgaaaatgagaagcaactgagagacacaggagaggcaaggtaaccaatcaggaccggccaccgaccgggaccaacactccttaccagagtgcggcccccaccagcagcttacacagctttttatggtattctgtccactaggtcaagcaatttcaaaccggactcctggaatgcagtgaacaataaaaaggataaccagaatatggttgtaagataacagttatcaataacaaacccaggaacatgcccaagatatggttgtaagaaaactgtgagggacacatttcagtcaacctagttcctgggaatttgggcccacattgtttcacaagatgcacccttagccattagcaagcaaagctaatatgtacagaagcaagagatctgcaataggcttttagccacactcactccattttgattctgattctacaatagatggctgtctttggagccactttttttcattttttcctaagattgagtggcacactaataaatgagagcttgaaattcgaggtcatttatgttgtctacatagctttcagacatttgctgattttgtagctttgtgtgatcagtttccaaaggtgatagataataaagaagtcagaatggcacctgttaaagaattgcagatctttagacattactattagcacatccagagggaagcacaactttattgtctacttaaagctgtgggtagttaactctcttaacttcctccttccctggactgacagctaaccagagtagctttctacagagaagggggtattgtactgagaaaaaaagttacctctgcctgaaactaaattgagataaagttaaataagcctttctcttcatgggcatttgttttgtttgaagtcaccataaactcagtgttgctttgctgtcagtggataccacagcttagctctttaaaaaaaataacttttaggccaactatggagtatttgaaatagcctacttccccttaaggggtcttgtctgccttcctttgtcctccaagacaactgttttctaccaaagtgaatccgtatttccaatgtgcttctcttggtctttgatattagctagttcttgtaggcatttccactggaacttgaggcaaatcagaaggaagttgattcttttaacatagaaaccaccataaaaaatgtatatgtacatattgctgaaaatatttggctatttaaaacatttttaaatgatataaacaccaaaaaatgaacaatgtgtaagatggaaaatggaaagatgcactgtctgtaactttgcacatttaagttactaagttgtaaatcaaatttggattaaactcactacatcgtcttattttttttctagatttatttatttacttcaaagtcagtggtacagagagagaaggaaaggcagagtgagagagagagagagagagaggagagagagagaggtcttctatccaggtttactcccctatgggccacaacagctggatctgcgccaatctgaggccaggagccaggagcttctcctaggtctcccatggggatgcaggtcccaaggactgggccatcttctactgcattctcaggctatagcagagagctggatgggaaatggagcagccatgtagaacctgtgcccatacagaatgccggcactgcaggtggcggctttacccactacaccacagcaccggccgcctccaggtcctttattagtgcaattatatcatttaatttaagagcatacagattgatcagtggcctctccaaagcacattttaggcactgaaatatagataaaacacatcttcaatcatattgtatggagttctcaccacatatactcttttagatttgtgtttagtgggctctctagattatcttaagaataacgtgagatttcaggatagaggagagagggcagttacttttcttgatgttcctcagagctatggtgacaccttgaacttacacttactgattcctcttgcatcctggactcagaactctggctgcagaagggagagcgcacgtgtgtgatctctcctctaagcacctgcgtctccttctgagtcctggtctctttctggagcaacttgttctgaggatgtttattctgataagattcagaggtgagtgtggacagaagtctcgtctctcagagaccatctccctgcggcagtggtctgccgtgaggggacattgtcagggcatcagaggaaaaagaggtaaagacaatgacctcagccttaaattataaactattcaatagaaaagcgactttctcctacataatcccaatgtaatcataaatagattatgctatcttccagttcatttgaagtttttaaagtgaacctcagtgactttgggatgtgaactctccgagtagaagcatgcgcactgcaggtaaacttgtgcagccctggtctgagctggggcagctggagacacagcccctgggctgagttctgagctgccctgggcccttcagctgggcacagccctgccccgcccctgctcatttgcatgtccccagagcaccacccacctctctgggcatttaggagcaggctgctcccgccccatgcaggaggcagtgccaggcaggacccagcatggacacgaggcccccactcagctgctggggctcctgctgctctggctcccaggtaaggaaggccagcagcaggaacggcctcgggcagtgtggccagggctgcctgtctctgcaggagcgtcctcttagaatgtgaggatgagtgttgtctctgtgtttctgtttccctcctcagg

SEQ ID NO: 143 - DNA, 11693 bp, Oryctolagus cuniculus
ccacagtgttccaagccctaacaaaaaccccccaggacagcagaagtgtgaggctgggctgccccagctgctcctcctgggccccatctgctgagagtgattctcagagcagccaggcttgaaggtcctgcagggtcgggtggaaggggccaggctgacccctctgaggctccctcctttcctcctccttggtggcagtctcagactcagtaatggctctaatatattaaggagagcaattatttactggggtctttgagtgtatagtgtcatttgagattcatagagtaaaagagaaaatattatatgtatggcaagcaaaaatagtttaaatcagggtgagtggagtcttccatgccctccatgtcctgggagaacggctgtcagagaaggagatcgtggacacagagactctcagattctcctagaggccaagcagctctggggcagaaggcacaggtgctgcccgcgtgtcctcagccctgtccaggaagccctggagtgggggtgctggtgctctctctgcctgcagcactcacaggggattctcccccgccccactgttcctggctctgcctgcatgagttgattgacagacgagaattctgattgtcttgtggtcaactattttatggtttgtcttgagtgcaaaagtgcccaaatatgccatcttgatccaacccaggtctctacatctttctgtgttttctctccacgtggcaatattccctctatagaggaggccctggcttccacagcaggaccagaggcacaaccaggatggtgtgaaatgcaccgttcactgcacccctgcttcagtccatgctgacccacacctgtcatgcagctccttctgcagtttggccaccaaacacagttctctcacaagcagttcacaccccagatgacgttgtttcagattctgggaaagtaagagaagtcgcgtttcctaaccttcctcatctcctctgtcccttctcatcctgggtcagtgctgccctctaaggtcaccgtgttctaatccctgcccccggtatggaagcagatacacagatcctaagctcttcttccactcaggttcctgcttgggagccccctgccgtcacataccgagactgaagagagatcatccaagtgtttcacccagcagagttgtatctaagaggaatgctgtgccaactcccctcacaataaactgctgtttgcctcttgtcaagacacccaatgggagcaaagtgaacactttgggatgtcagagcaggaccagggaggaggtgaaaggcgttatcttccttggtgtttgcttggtgcattgttgctgtaatgaattattccattctctttggctcagacaactccaggtgtattcttgaggtcaggagctcagcgctctcctggaagaagccctggaggcaacagggttgtgctggaaaccacagggcatgggattccattccaggtttgtccagcgtcaggatggccacatttcctgctctgtggcccattcccccttgcactccacggcctgtttccctgtcacagcctttggatcctgcccctcccccaacttcaggaccactgtgatagtatcgctcccaccaggtccttctgcgtcatctccccatcacagtccttaatcatccaacctgcccagctccttagatgacagacctggcgagcaggcagtaggctacggatggcttctgtgttggagatgatttgtatcccatcttacactcttaccatctctgccactgtctcccttgagacagaattagagctgatagggcagatctcagagcaacagagttggaggagatctagaccgaggtgcagtgacattgacctgtgtgtgggagggggcagggaattttaatgccgcctctaatgtggacttcatggagcacagctgcttggcagagtttgataaatgcagtgtggttttagaactcagaatctgatgagcgccctagcaaagagtggctgttctccaggctcattcctattgttgtgagatgggactcaaagttcagtaggttattttccttggttgctttagagcaaggcttgttcataaacttcaatgttagtttgtagctggcccatttctagcttctgtacctctgcttgcttgataatggccaaggccactagactgtggtttctcctgtctcctctcgcctgcagacttggaatagctcaggagccgtcaaagttacaaaaaaacctggctaattagctaactgcttctcccttctgtacacctgctttctgctcacacaagctcacacacaggttcaaatgtctcataaaaagtgggttctgcctttaaaaagcccccaccgccgcaactcagggctgtcttctctggacttgctctgtaacggggccgttgccagcctgctcataaagactcttgatttgagttcaaaatctctctgtgtcttaatccatgcgccccactacattgtaaccagttggatgatgctcagtgtgttgtataagcttcattttgggcatgtctattcttctgctttgctcattaacacagacccagtgcctagagactggaacttggtgtatagtagtagacaggaaatatttgtcaaatgagtaagtgattgcacacatttacatgtgtttgcacaatttaactgagacaggacaattgctgtccctacaacaaagcccccgagagtttcagagtcgtggattcatcagcttcttggagcctccacagtgaagatctcccaggcagctgcactccagatgtgcagagctctctccctgactcgtagtcagctccctgtaggagtggccggcagccttcagttggataaaacttacatcccccagggtctctgctccttcctcttttcttacccaggagctagttctgtattctaaggacacattggtttggtttcatccaccatgtcacaggatccatgaagagatgcatggctctgtggcttcctttgctttgtcttccatagtattttctctctctctttctcttcctttcttcctttcttcctttcttctagttatttgagaaggagagttacagacagagagagggatagacagagataataaagttttccatctgctggatcagctccctaatgttcccaatggccaatgcctgactgatccgaagccaggagccaggtgtttcttctttgtctcccatgtgggtgaagggacccaagtgcttgggccctcttccactgctttcccaggccatagcagagagctggaatggaagaagagcagccagggtacaaaccagtgtccagatgggatgccggtcctgtaggcagaggattaatgaacttcaccatagtgccttcccctcaactgacccttactcatcagcgacaatttgtaaccctagatgccttgtcacagaatccaggggattgtgagcagttaatttagatacttaattcaacctcctggatacttcagaaagtgcatggagagaatgaggagagaagcttgtttttctgcaagaaatgttgaaaccatgcataatttttcataatacggattttccccatcttttgaagaccgcttgtgaatgtggcatcagtacacggaaggtatgagtgtgctgggtagaacaaggacagcaggtgcacaccactgtctctcggagtctctgatctctgtgtggactccgctcctctgggacaagcgaagcagcctcgggtcacccacagctgccctctgtggtttctctgcacaaacccatctcggagcacgaggccccgcacactggtcagtccctcttgtcactgtctgtagggctgtctctttgtgcttaaaaaattcaaattgcttttaaagctgtttatgcgacaactaatttggaggtgagggcagtgaaaatggcagacaagtaggtgggagaggagaagcccgagagccaaagtgagctggaactgctggagttacagagggggaagtttcaggcgcagcactgagaagccatcagctgagaggaagctgagccctcccaacaaaacctacagagatctgcaggtctgcattggccacaggtggtcagatgtccaagacagcatcagccacatgcaccagctgggtcaataagcctgcagagactgctccacctctggctgcaaactccctctcagtagcagggcttgtaatgaagatgaagatggggaaccggagcagaggcctccaggagtcaaggtgaggatgaggagcactggaaggattcgccagcatcagccgacacatccctgcaggagggaaagcacgggttttctgaggagcagaggctctgggagccagatatcaaacctcatgctggaaatggccgtgaccaagacaactgaatgacgcgttttgtaactggggatgggtgtggggtgggtgtcaagttgaaaggaacaggttccctttttgaagaatggtataaggcagtctctgaagctgctttgttttcttctttttcatattttttaaatggtgtcaaaagggaacaatttcccttttgaaagaatgatattgttgtaccagctcgtcagctgaaatagagtattacaataccagtgacagtcacacaggaattttattgaaaatgagaagcaactgagagacacatgagaggcaaggtaaccaatcaggaccggccaccaaccgggaccaacactccttaccagagtgcggcccccaccagcagcttacacagctttttatggtattctgtccactagggcaagcaatttcaaaccggacccctggaatgcagtgaacaataaaaaggataaccagaatatggttgtaagataacagttatcaataacaaactcaggaacagacccaagatatggttgtaagataacagtgagggacacatttcagtcaacctagttcctgggaatttgggcccacatagttgcataagatgcacccttagccgttagcaagcaaagctaatatgtgcagaagcaagagatctgcaataggcttttagccacactcactgcatttggattctgattctacaatataaggctgtctttggagccactttttaattttttttaagattgagtgttacactgtaggagttggagtccctagcttgctaaatgctggtttctcactctggcttgcttgcttgacagctgtaaggccatgacaggcctcattctggactgggaaggaggcaggccgggtccttgagaacaaagaaagtaagctcctctgggatttatggcccaatgcttcccgccagttcctccctgtgccatctcctttgtgtggcgttcccaccacataatgtatgaaccaatggacatgttagttcccaataccttgccatatagagaataagaaggtaacctatgcgagatgatatgcacccttgtaagtgtgaggctacaaaaacctcttttatgcaaacgacagggccttttgcctgtgcactgccgaaggctgtgtgcggattgggggtcccagacggctggtaacaaataaacctcttcgtttgcatcttcgactgtgccttgtgcattgattgggaaatttggacactacaacactaacaaatgagagcttgaaattagaggtcatttttgtctatacacagatttcagatatttgctgagtttgtagctttgtgtgatcagtttgcaaaggtaagagataatatagaagtcagaatggcacctgttaaagaattgcagatctttagacattactgttagcacatccagagggaagtgcaactttattgtctctttagagctgtgagtagttaactctcctaactccctccttccctggactgacagccaaccagagcagctttctacagagaagggggtattgtactgagaaaaagagttactattgactgaatctaaattgagataaaatgaaatacagccttttctacatgggcatttgttgggtttgaagtcaccataaactcggtgttgcattgctgtcagtggataccacagcttagctcttttaaaaaaacaaaattttaggtaaactatggagtatttgaaatagcctacttcccttaaggggtcttgtcttccttaatttgtcttccaagacaaccgtttgctaccaagtgaatcagtatttccaatgtgcttctcttggtttttgtttcttagctagttcttgtaggcatttctaccggaacttgaggcaaatcagaaggaagttgattcttttaaaatagaaaccaccaccaaaaatgtctatgtacatattgctgaaagtatttggctattttaaaaaatttttaaatgatataaacaccaaaaaattaacaacgtataaagatggaaaatggaagattcactgtctataactttgtctgcacatttaagttactaagttgtaatcatatttggattaaacacactacattggctttttttttttttatttgacagagttatagacagtgagagggagagacagagagaaaggtcttccttctgttggttcactccccaaatggccgctacggctggcagtgtgccaatccgaagccaggagccaggcgcttcttccaggtctcccatgcaggtgcaggggcaaaagcacttgggccaccctccatggccctcctgggccacagcagagagccggacttgaagaggagcaaccgggactagaactcggtgcccatatgggatgctggcgccgcaggtggaggattaacctagtgaaccattgtgccggccccaacttatttttttaagatgtatttatttacttcaaaatcagaggtgcacagagagaaggagaggcagagagagagagagagagagaaaaaaagagaaagagagagagagagaggtcttccatcccctggtttactccccaatgggccacaatggatggagctgcaccaatctgaggccaggagccaggagcttctttcaggtctcccatgggggtgcagaggtccaaggactcaggccatcttctactgctttcccaggccatagcagagagctggatgggaagtggagcagccatgtcgaactggtgcccatatcgaatgcaggcattgcaggcagtggctttacccactgcatcacagcactggccccctccaggtcatcttattagcacagttatatcatttaatttaagagcatacatactgaccagtgtcctctccaaggcacactttaggcactgatatatagagaaaacgcatctgcaaacatattgtacggagttctcaccacatatactctatcggattttttttttttttttgacaggcagagtggacagtgagagagagagacagagaggaaggtcttcctttgccgttggttcaccctccaatggctgccacggccggtgcgctggcgctgatctgatggcaggagccaggtgcttatcctggtcccccatggggtgcggggcccaagcacttgggccatcctccactgtactccctggccacagcagagagctggcctggaagagaggcaaccgggacagaatccggcaccccgaccgggactagaacccggtatgccggcgctgcaaggcggaggattagcctattgagccgcggtgccggtcaaatatgacctctttttttaatgtgatggttaaactcatttcaaaatataggtctcagcaaaaaaaaaaaaaaaaaaaaaaaaaaaaaaaaagggatttcgcgaaaactcctgggatgttgaacgtggaggcagctccagactctgactggggtcaccactccttgagctcttctctaggtgatagctccagagaagcagcctgtgggtgttcctaacgcgtcgtgcactgacctctaagtctagagtaagccccagtgaaacactggaaatgcatatagaactgttagctcttccatggttttatcataccaagatacatgaatttaacttaattaaatgcaggcaaagtatctgaattttgtccatttaacttcttaaaataacatccctctcctacacactgatttcttgatccaatggaaatacttaaccttaggtcaagatgggagagacatgaatacaatgaatgcttttactaaaatactaataaatttctcaaacaacaaaaaaagacaatttcatatttcaatatctacattttttaaaaaaagatttatttgcttatatgtaaatcaatgatacacacacacacacacaaataccgagaaagagagagagagagagagagttttcttccaaatgctcttacactctacaaatggctgcaatggccaggtctcccatgtgggtttcagagcccaatcacttgggacatcttcagctgattttccaggacattcatatgttggaacaggatttgaagtggagcagccaggattccaaccggtgcccatgtgggatgctggcattgcaggggtggctttacccactgcaccacagagctgccctgtcgtgtgcatgttttaagagcatcatgatagttcaccatatgctccatcctgcctcactcccaccctcagtgctcttccttttttaatttttatttatgttatttttaaaaaggatttatttatttatttgaaagtcagaattacacatgggaggagaggcagagagagagagagagagagcgcgagtgaggttcactccccagttggccacaatggcaccaatcagataccaggagccaggaggttcttctgggcctcccacccgggtgtaggggcccaaggacttgggccatcttctactgctttctcaggtcattgcaaggagctggattggaagtggagcagccggaactcaaaccattgcccacatgggatgccggtgcttcaggccagagctttaatcactgcgtcacagtgccggcccctattttaacttttgaaatgacatactttcaatgtactttataaacactagctcagccttccatatatacagaattccccctatccctctgtcattaccagacctgaggtgcactggctccccctgggggtcacaggtggaatcgcgtcagctttcaatccctgatagagcagttcttcatttaatctgaaatcaaatagagaattctcatggaactgaaccaatagtaacttcattgtttgcatgcaatggcacacaactaaaggattcacaatctttgtagacgtagattaaatgggaaactcgaacagaaccctttatctcatagatcttccattgtagtgtgagggctgataacattcaaaccaataatgttctacctctgctcctgatattggaatttgacccccctagatataatttagggtgccataagatatcaccatgtgcttattaataagttccccatattaataagccaatgtgggttcttgcctagtattcagagaagaattctgaatacaagcaaaaatgagtgaggcagcatggtacattttaaacttttattcagtgagaaagatgcataggagatgagggccccgtctaaaggagagaggtagagctgggttcacaccaagtaccaggaaccagccatgtggaggagcatctaggaccagcgccatggggcagatggaccaaaggccacatgccatggaggcacagggctgcagccagccccctactggcaagaagccagagaaagaagggagggaaaaaggccagacacaccttgtctcaggcttttaatccacttccaaaggggagtggttaattcacctgattggccagtgggcactcaggtgtggccaggtaggggcatgaggtcacacaggggcgtggtgaaggtgtggtcttccagctcacaaacctaatcaatcttaacctgtgtgcctgcttccttcactcccactctgctccatgtgagaggcctcccttggagcaatgatattgctcaggacaggtgagcagtgggtatccaagtccacttagtgcaaccccctgtctcagcctaggcaggggcagaggcagaggcagagggaataaagtaggcagttcaacacttgtgtttcctggaaaaacaaactaattggagtctcattaatggtgaaagccaaattgtcctttaatggaggaaaaagtgtttaaaatttatcatgttcatgtagcacgaaaccaggcaacacacaggtcagtggtaagagtcagtgctctgacactggagataacaaaaagtggagcccagttttaagagtgtcttttatcgtgtcaacagttatttctagtatgttaattttctgtaatgttaccattctctacttttccaaaatatttatttatttacttgaaacctgagcatgggagggaggtaaagacagagaaagattaggagggagagaggagaggaagaggagaggagaggagaggagaggagaggagaggagaggagaggagaggagaggagaggagagaagagaagagaagagaagagaagagaagaggaggggaggggagggcaagggaggggaggagacgggagggaaagtagggaagttctataatctggtctctccacaaatggctgtaacagtgagttcctggccaagcagaagcccagagccagaactgcccctggtctcccctgtggggcaggaatccaagaacttgggccattttctggtgcctcccagggtgtgcatttgcaggaaatgggatcagaagtggaacagtggggattctaacctgactctgacataggctgctggcattgcaagtggcagcttaatccactgtgccatgatgccagtctatcctcctctctagcttttcttaagaataaagtgaaggttttaggacagaggagagagggaagttagtttgcttgatgttcctcagacctatggtgactccttgaaacttgcacttatctcttcctgttgtatccttgactcagaactctggctgcaggtggggagccgcacatgtgtgatctctcatctaagcacctgcgttctccttctgagtcctggtctctcgcggccgcttgttctgaggatgtttattctgagtcagtacagaggtgagtgtgggacagaagtctcgtctctcagagaccatctccctggtgcagccgtctgctaaaggtgacaacgtgaggccatcagaggacaagaaggtaaaatcaatgatctgagctttaatttgtaactgatattccctagaaatttctttctcctacagaatccaaacataaccatgaatatattatgccatcttggcctccagttcacttaaagttttggaaaatgtccctcagtgactttgggaggtgacgtcctctggtagaaacatgcacactgcaggtaaacttgtgcagccctggtctgagctggggcagctggagacacagcccctgagctgaactctgagctgccctgggcccttcagctgggcacagccctgtcccgcccctactgatttgcatgtccccagagcaccgcccacctctctgggcatttaggggcaggctgctcctgccccatgcaggaggcagtgccaggcaggacccagcatggacatgagggcccccactcagctgctggggctcctgctgctctggctcccaggtaaggaaggccagcagcaggaacggcctcgggcagtgttgccagggctgcccgtctctgcaggagcgtcctcttagaacgtgaggatgagtgtggtctctgtgtttctgtttcccttctcagg

SEQ ID NO: 144 - DNA, 10164 bp, Oryctolagus cuniculus
ggatctgggacagagtacactctcaccatcagcgacctggagtgtgacgatgctgccacttactactgtcaaagtgcttattatagtagtagtgctgataccacagtgttacaagccctaacaaaaaccccccaggaaagcagaagtgtgaggctgggctgccccagctgcccctcctggccccatctgctgagagtgattctcagagcagccaggcttgaaggtcctgcagggtcgggtggcaggggccagggtgactcctctgaggctccctcctttcctcctccttggtggcagcagcacagacatgaccatgaccctactgttctaaagtaaaacagttattctttctgagtatggaagctagagcattatttgagattcatagagcaaaagagaaaacattatagatattacaaggaaaaatattttaaatacaggtaattttttataaaggatacaaatttcacatgtacagttttttatatgtagagttgaatacatttattagcttatgaaagcccatgctttaacagacacacacaaacacacacagtggagagagagttctctttcatctgctggttctcttctccaatggctacaccggctgagactgtgcctgccaaaagctgggagatggaaattcttttttttttttaagatttattttattgatttgaacgacagagttacagagagacatgcagtaaaagaagtcttctatatgctggttcactccccaggttgctgcatagccagagctatgccgatccaaagccagcagccaggagcttctaccaagtttcccatgttggtgcaggggcccaaacatttgggccattttccactgctataccaggacatagcagagagctggatcagaagaggagcagccgggactagaaccaccgcccatatgggatgctggcgcttcaggccagggctttaaccctctgtgccacagcaccaggcccgggagatggaatgtctttcaggtctcctatatgggtgccaaggctgaaacacttgttcctgctccctgctgtggcctgagaaagcagtagaagatggcccaagcggctggacccctgcgcccacatgggagaactggaagaagctcctggctcctggctttggtttggcgcagttccagccaatgtggccagttgaggagtgaaccagcagatggaagacctctctctctctctctctctccctctttctttctttctctctctctctctctctgcctctccatcactctctgtgtaactctgactttcagataaataaataaatctaaaaaaaaaaaaggtgcagggaagaagaaggtatgtattaactttcctttgtgggcttgagaacagtgagcccctatcacagcctcctaatggagtgcagctggagtgctcacaacagtcaagtcacacagagattctgtgcagccgctgtgctgggctttgcacggagagagcggtgtgagaagaggaaaagagctcagattaggagctgaagagcctgctttagtctcagtgctgctgagcgggagaagaccaggtgctctggcctcctgttccctgagtctaggtgggagggacagagggcttcccaggttccttttgctgtcaggctctttgttatgggggtggaaaaggtggaggtgcagtgttgctgggagctgcagagcatccgagtggacagcagcgggcggggaccccgtggttcagaagaaagcccatcttcagtttcccaccaggtgcccactggcttttttcccatccactaacagcaaatgttcacaacaggaaagctgggtgtcgtttaccgattgtgacgaacgcatcgatgtgagctgtcagctgggtgtgcagtggaaaggcactgtgtgtactgcttcacaattttttgatttgtaaattataagctattctgaaacggaaagtttctttacacaacaacaacaataacaacaaactgagtatcacagcgaactgtgaaaaagaaaaaaatttacctctggcgtgactttagtgttcatattgtcctgctgattgtctgccagaggctgacgggcatctgcaaatcagaaatcagccctggaaagagtcttttaaaattgtgtatgtatttatttttatttgagcaggagagagagagaaagagagagagacagagatcttctgtccactggtttactcccccaaaggccaggctgaagccagtagcccaggactccgcccaggcctcccacgtagatggcagggtcccaggcacctcagtcctcactctcagggtgcacatgagcaggaagctggcatcaggagcagactgggattagaccaggcactcagtgtgggatgtgagcagccaagggccaggctgatgccaggggtcagggactccatctgggcctatgtgggtggcagcagccaaagtacttgggccaccatctgccgcttcccaggtgcatgagcaggaagatgcatcagaagcggagctgagactcaatcccaggcactcaaatgtgggctgtgggtgttccaagtggcagctgaagactctgccacagcatccactctgcctaatttctattatttatttccttccagtgacttttggtttggtttttctatgtcttgagatcactgtcacattttaatttgatgtctttcaggttttttttggatgtgagtacatattgcattaaacttccctggcacctggctttggcctggcccagccctggcatttgtgggccctctggggagcgatttctccctctctgtgcctctgtctctccctctctgtaactctacctttcacataaataaattaacaaatcttgaataaaaaaaaggcctgagattgcagtttccctgcagccacttgctcaggggatactcccccctccctcagcttggagaatcccagttcacgtttatccagctcctcagaccaggagtcaaacgcagagcagtctggatgggctgcctcacaagcaactgcctgcttccaggtttcacacgtttcttatggggtgggtgcatgcactcgtcaggtttaaacagcatggattttggtgttgtgaatcacatcgagaatccagcaggatactagaatagttaggatcttggtcatggattacgcaggtgcactgcgttcccacacttgatgttacctatgtgcacaaacagtgaggtcgctcatcattttcccacgatggccctgggctgtgaagcttcctccccttagggcgcagcagtcccctgggtcacagagtttgctgagaagctgtgctccttgggggactgactgaaagcaagagtgtatcagattacattagtcccaaaagtccaggaggggtagagggacgatgatctgtctttagagctacttcctgctgacatggggtgatgaggtgctctctgctggcatggggcgatgtctcaagccgctgtctcctgggtggagagctgagtatatccctgtagcagcattatgttgaccacctggttgctgatggccttggttcgttcccttatcaactcctgtaaagacttaaacagacgcggtagtataaaagacagagtgagaataggaaccaaagatcctaagagtggcattaaccaggtaatgagaggtttcagagaggagaggaaatgggggagggggctctggacccttgtgagacctgtttgatggacgtggttcaaagctgatcccaagcaaccgggagaaaggccactcaacttttgcaggtagaggggtttgtctgtagggaaattctgaacaatcatacaacatcaggtgggggagaggcccatcaatacacacaggtcaggagcaaatccattgatgttagagcagagactatgattataaaggaatgaggccccaagtgggctagatagggtctagaacaaaggacagagtcattactagaggacccaagagagctgctgtctaaaccatgactgagtttctgattgagaggcaaatagaaactgacagaagaggcttgataataatcaggtgggctttaaggccttgtcagttatgaggcccagacctatctatctcttcacatgggttacatcctaagggaggtgtgaacctcttggggaagacaccctgttgacttccattacctagctggcctgggaggagagctggccgggtaaaggcaggtggcatccctaacaggaaacttacagttctgcctgcaatgttgctgaccttacttggctgtcccctcagcagtggtggtcactttggaagctgggctgagtgaagggctcttcagcttggagccagcaagatctgtggctctgacctgggcgtccttcgactccagggcagttccatttccagagatccaactcttggctggcagagctgacagggctcttcctagctgacttctgctgaacccaggcttaccacactgaaagccactcagcgcactggcctgttgggtctctttgagggcagatcactgtgcagagctgccccctctctttaagttgcttctgatgcctagcttccttttcctcctggtttttgtcaaagcagaccagaggatgcaggtgaaggaggtgctcatgtcccatctctaatcttcggtggcctcaactagaagcctaaagtacaggcatgttctgatagtggttttccctgaggtagacaatgcacatgaggaaagctatgtcctcactttcaaactttctctccctctgtttggtctgaaagggacgttttgcctgtttactgtgcccatggcgaagtaaatccagctgtgaaattataatttaagctttccttttggttatgctattacagaaatctgttagccatctttttacaaggtctaaaaatcaaattgtgcatctaggagagtcctttggaatagagttagtttcctaccttgaagagaatagagaaatgagaggacaagttgggcttagaatagagagatgagggagcaagtcccagattgcttactgaccatagcattatcaaatgaaaacttagaaaagaatttcaaccattaaatgacaacttaggacaacatttaccagaaggtccaatgccttctataaattttaagaacacatgtatttggaaacatctcttaaatatctaacatggtgtagcttgtttaaccagcaaattcaagcacaaacatatagaaacctttttagtttctttctacaaaccaagttaaaacatctgatacagagattcaggtcacatggatcaaatgtatctttgattaattttatcagtttaaatttatgggcaatcttttatctataagccaaaaaataaagttcttaatgaattttcccatgtagacatacaatatgtatacacatataacaaaagagatagaacagtaaaaccatttccacaatagctttttaaactcttcaactgttttttaggttaccattgatttggattacttcctgctcttagttacctgaattaaccctgctttcttccaggtggaacctgtagtgcattattggcttcatctgtttacagagccatcccaaagtactgagtacagcagaagtggctgggaaaagtccatcagaacctatacaaaactgtgaatgacagaagcctttatatagccatgtttaaaattagaaaccatgaaccaacaagaggcagttgtgtccttcacacagtagttttgaaagcacctgtagggttttacagaacatttaactgtttaggcctttgggtttttctcattaagataatcatcatgtctagtaacacaagatcattagactttttaactttaggacttttttttttttttttttgacaggcagagtggacagtgagagagagacagagagaaaggtcctccttttgccgttggtcaccctccaatggccgccgtggccggtgctctgtggccagcgcatcgcactgatccgaaggcaggagccaggtgcttctcctggtctcccatggggtgtagggcccaagtacttgggccatcctccactgcaccccctggccacagcagagagctggcttggaagaggggcaaccgggacagaatccggagccccaaccgggactagaacccagtgtgccggcgctgctaggcggaggattagcctattgagccatggcgctggccaggacatttttatcagtagcattttatatgataaaacttataatttagtaccacttcacatcttgacagtacttctagtataatccaaatagcctgattagttggtgtctcttcaagatgagagacacatatcctttgatttttccagttggttgggcccaaactggaaaaataaaagtccactttactggaaatttcagagtccaaattctttgtaactttgatttttgattttttggaatgcctgtcaaggatgccaagaaagcttaaagtatctgcttgaaataagatccttcaccatcaggacataatatagaccaaatttgatcattgttagaagacgattattcaaatgttttagaataagcatttatttaaataaaccaaagctcttaataaaacactcagctgtttctaaacttttagaatttaacagcggcatcaagagaacataatagattacttttgatggaacaaggacataagcctcagcgattctccctcagtgcccaatggagataaactttgggatgtattccttgcccttgaatctcaattgggtctgacaccctattgccttcataccccaccctgcattcttttccaggttcaaaaagcatccccccacctccagttcctggaattcccttccctgctgcctcctacccccaccccagccctagccctcctggcctggcatctgggagtcaaggccttttgccacaggctccatcttgtacacacaggcagttggtcacccacctctgcggatttattttctctgaataaattcggtctgtctgtaaattcgtgcattgcctcttctctaatctgcaatggaggaataaccaagtgagtcatggcactggccccttaaacccatctttaaaatagatgtctcagacaaaaaaaatagtgtaaggatttcatgaaacctcctgagatgttgaatgtggaggcagctccagactctgactggggtcaccactccttgagctcttctctaggtgacagctccagagaagcagcctgcgggtgttcctaacgcttcctgcactgacctctaagtctagagtaagccccagtgaaacatggaaatgcatatagaactgttagctcttccatggttttatcataccaagatacatgaatttaacttactttaatgcaggcaaagcatccaatttttgtccatttaccttgttaaaataacattcctctcatacatactgatttcttgacccaaatggaaatacttaaccttaggtcaagatgggagagagatgactacaatgaatgtctttactaaaataccacacacacgcacacaaatgcagagagagagagagagagagagagggagagagagagagagttttcttccatctgctgttacactctacaaatggctgcaatggccaggtctcccatatgggtaccagggcccaatcacttggtacatcttcagctaattttccaggccattagtatggagctggattcgaagccagcactccaactggtgcccgtgtgggatgttggcattgcaggggtgtccttattcacaacaccacaatgctggcccgtcatgtatatgttttaaaagcatcataatagttcaccatgtgctccatcctgcctcagtcacagtgctcttctttttttattttgatttattttaaaaggatttatttgtttatttgaaattcagagttacacagagaggagaggcagagagagagaggtcttctatctgatgattcactccccagttggccacaatggctggagctgtgccaatctgagccaggagccaggagcttccatttctcccacctgggtgcagggccccaaggatttgggccatcttctactgctttcgcaggccatagcagggaggctggaacagaagtggagcagccgggactcaaaccatcacccacatgggatgccggcacatcaggccagggcattaacccgctgcaccacagctggcccctgttttaacttttgaaagacatactttcaatgtactttataaacactagctcagccctccatatatacaaaattcaacatgtagtaagcagaaaaccactgttcctcatcccaaagacaaggctttgagtctcaatccccccaatacctctgtcactaccagacctgaggtgcacttgtgccccctgggggtctcaggtggaatcatgtcagctttcaatccctgatagagcagttcttcatttaatctgaaatcaaatagaaaattctcatggaattgaaccaatagtaacttcattgtttgcacacaatggcacacaactaatggattcacatctcttgtagatgtagactaagtggaaacatcgaacagagcccttcatctcacagatcttccatggtagtgggcagggctgatgatactcaaaccaataatgttctacctctgctcctgatattggaatttgaccttccaaaaatataatttggggtgccatacgatatcaccatatgcttattaataagttccccatattaataagcccatgtgggttcttgtctaatattcagagaattctaaatgctggcataggtgaacgaggcagcatggtacattttaagcatttattcagtgagaaagatgcataggagagtgagggccccgtctaaaggagagaggtaaatgtgggttcataccaagtaccaggaaccagccacgtggaggaacatctaggccaggaagcgtggggcgggtagccaaaggcaacacaccatggaggcacagggctgcagccagccccctactggcaagaagccagtgagagaagggagggaaaaaggccagacacaccatgtcccaggcttttaatccacttccaaaggggagtggttaattcacctgattgaccggtgcccactcaggtgtggccagcagtggagcagtggggaatcaaagcagtctctgatgtaggctgctggctttgcaagtggcagctaatccgctgtgccacgatgccagccttccctcctctctggattttcttaagacaaacgtgaacgtttctgaagaggggagagagggaagttaatttcattgatgttcctgagacctatgatgaagccttgaactttcacttctttttttgttatgcaacctgatcagaactcaggctgcaggtgggagagcgcacacgtgtgatctctcctctaagcacctgcgttcttctgagtcctgatctctctctggcagccgcttgttctgaggatgtttattctgatcagtttcagaggtgagtgtggacaaaagtctcctgtctcagagaccatctccctggtgcagcggtctgccgtgaggggacaacgtgagggcatcagaacacaagtaaagaaatggccttaggcaaaattagtttactatctattttaaagaaaaggaaatttctaggcaaaaattagtttactacctattttaaagaaaaggaactttctcctacagatcccagataaccatgaatttattacaccatcttgtccgataaactcacaattttggcaaatgcccctcagaaagtttgggaggtgacgtctcatggtggaaggatgcacacatcaggtaaacttgtgcagccctggtctgagctggggcagctggagacacagcccctgggttgagttctgagctgccctgggcccttcagctgggcacagccctgccccgcccatgctcatttgcatgtccccagagcaccgcccacctctctgggcatttaggagcaggctgctcctgccccatgcaggaggcagtgccaggcaggacccagcatggacatgagggcccccactcagctgctggggctcctgctgctctggctcccaggtaaggaaggccagcagcaggaacggcctcgggcagtgtggccagggctgcctgtctttgcaggagcgtcctcttagaacgtgaggatgagtgtggtctctgtgtttctgtttccctcctcagg

SEQ ID NO: 145 - DNA, 10829 bp, Oryctolagus cuniculus
ccacagtgatacaagccctaacaacccccccaccaggaaagcagaagtgtgaggctgggctgccccagctgctcgtcctgggccccatctgctgagagtgattctcagagcagccaggcttgaaggtcctgcagggtcaggtggaaggggccaggctgactcctctgaggctccctccttcctcctccttggtggcagcagcacagacatgaccatgtccctactgttttaaaggaaaacaattattctttctgagtatttgaaactagagcattatttgagattcatagatcaaatgagaaaacattatagatattacaaggaaagatatattaaatactgtaaattagaaaaatttataaaggataccaatttcatatctacagttttttatatgtacagtttttaaaaaagttttgtttgcttatttaaacatgctttacactcacacacagacatacacacacagtgacagagagagaattctcttctatctgctggttcactcctccaatggctgcactgctgaggctgtgcctggcaagagctggggcatggaacttctttcacatctcccacatgggtgccagcgttgaaacacttgttccatccgctggtgcggacattagcttggagctcgtttggaattggagcagccaggactccaccggtgcccctgtgggatgctggtgctgcatagggcggctttacccactgcacaaggctggcccaccctatccagagttgtgagagcataatggcacttcccaccatgtcctcccattctcaaaccaccccaacttctcttctgttttgtttaaattttacactgacatactttcactctataatcaccagcttaactctccactaaacaaaattcaacacggagtagtagaaaaaacacaattcctcaagagtctagtcaaggtatgagtctcttcctcccagtcccactgtcactaccagacctgaggtgcactggcgccccctgtggtgagaggtggaatcctgtctgctttcaatccctgcttgagcagttcttcattcaattcaaaatcaaatagcaaattctcattgaattgaaccaatagtagcttcattgtacacagtggctcacagtgaacagtatcacaatctcctaggcatagaagaattgtaaaattgaacagagcccttcatcccatagatctttcattttagtgagcagggcaggtaataacatgcaacggtctacaactgctcccactctggtccatgtgagaggcctcccctgatgcactgctatatattggggcaggtgggcagtgtgtgtccaggtccacttagtgcatcctcctgtgttggggcagaagcagagggaacgcatcaggcagttcaacttttgtgcttcctgaaaaagttaattaattgtagtctcagtcctttggttgaggaagaagctttttaaatttctcaaattgctgaggcatgaaaccagtgaacacacaggtcagtggaagaatcagtgcccttggctggcactgtggctcacttggctaatactccacctgtggcactggcaccctgggttctagtcccggttggggcggggcgtgggtattagtcctggttgcttctcttccagtccagctctctactgtggcctgggagggcagagaaggatggcccaagtgcctgggttcctgcacttgcatgggagaccgggaagaagtacccagcacctggcttgggatcggcacaactccagcctaatggcagccattaggggagtgaatcaatggaaggaagacctctctgtctctttctctcactgtgtcttactctgcctggcaaaaaaaaaaaaaaaaaaaaaaaaaaaaaaaaaaaaaaaaaaaatcagtgcccagacactggatatataaagaggaacccaatttagtaagggtgtcttgtactgttgttaatatttatttcttgtgaagataattttctgaaatgttcaccctttccatttttcaaaatatttttttatttacttgaaagagtgagcattgatgagctgcaaaatgtgagtgactgagtgggaggaaggcagagacagagagagacggagagagaaagtgaatcttccatacactcgtctttccccagatgacccttacagctggggctggaccaggccaagatcagggccgagaactctgcgttgggctcccagtgtgtggcacggatcaatgtacagccgtttccctcgaagtgtgttatatctattgctcttttacatcacaccaaggccattagggaaatagagaaagcagaagctgccctgccgcagtgacgtccagcagaaccacactgaaagtcagaggtacacatgttaccacagaagcaaagggtccttgtcttcccacaagaaagaactcaggcatgagacagagagtagtggaaagcaaaatagcaaggtttattagcgtagggacatccgtaagaacggatgggctcctctccagacaggacctgagagagagtgcatatggcacatttaggctggggtttttaagggaatggatcttgccatccctcctcctctccttctccttctgggacaaaggacctgttagatgtaaatacaaaaaattcctttctgagtttttccccctgaagttgtcagacaggggaagcctggctggcctagccccaccttagaggaaggatgtttatcaggccagggagatggggcaggaccttgtggaaggtcatcaggatcctggcaggacttttgaaaagcagatactgggctgcacctggaaggttattgggatgatttgaaatgcgggccggagcactgaaaatgtcaattctttaggtctttgtcacacacacacaagctcatttctgacttcctacctaatattcccccctcaagagagagatacccataattctttttgggataaatggattgagttccgttttctgtagctacttccaagatgacatacgggcatagagatggatataggtatttcctcttgctctctgtcctatggtatgtgacagtagccttggaaagactgtcctgctctgtccagagggctgctcaggttgtccaaatgcatggactggaagccttgtctgatgaacatttcaagttcgacagcttttattccgttagagacaaaatgaatgaaggcattaaaaatgcacagaccaaagagaagcagcaagattacagaagttacagggccaaggataggcaatagccaggatttccatgaccagatgtcaggccagaaatcccagcccttcttagcttggtcctggagctgtttggctttgtccaggaaagtacgaagttgggtttgtacctgtccagtctgattgacccagaaacaaccttcttcccggagcatggcacagacaccttcctgagccgcagttagcatgcccagtgcttgtctgttttggagaacaacagcagcgaaagagttgatctgtttggaggatgaagagagaagctgctatttgggtgttaagaccagccagtttggaggagaggctagtagacatattgtttgctgatactgcccctgttgtgcctgtagcaactcgtgtcactccagccaccatgctgatccctaccaggacagggattagaggggaaatcctcttggagagttgagaagtagtgtgtaagggaatcggtgtaggggctgaagcattagcaacagatatagtagacaggacataggccatggtacagagccctgtccagttagaaagtaagcattggtaagcaagagtcccacagacaaagtatatcccccctgtgggagggaggcatccagagaggtggtgtatactaagttgggaattttcagtagtggtgcgtttgaagaagtaggtggcaacaaaggaagcttcagttagtagactaaaatgtggggtgttgttgtgggaagtactgctcatctgatcttcccagaacattacccatctagaggtgtcgatgaaagtccgggccaacttgccatcctcatgaatgagggagcaattatctattcctatgttgccccaatgagaatcggccattaaagctgaggcacaggggggcttttgcccttagtgtgaccttagtatagataggtcctataacaggatatgagaggtcgtcttttttaattgatgtgtgaacaccctgacgcccagtagaagttgagtagtacatatatccttctgtctgagcccattcccttagagaggctggccatgcttccccagatgagccccgtgtctccaggcaaatccagcaggagtggccataggaagtgttggccaataaagtgcagcctgcagtggcctaataaagggtgaggcatcagttaggagtacgggtgggaagcatgccagtagaaagaaaaaaggaaggcgtgggcacggcatctttatttatctgggctccttttaaagagtaggcgcaaatcttccagaggctccattgaccaggtatctttaggttcaggatcctgctggtcttcagggcagtatggctttaccaccactttcccctggaactggcattaaggtagctggattcaaagtggagcaatgcattatttttacctgagagttttctagaaggaggacctgatattttagtattctactatctgtgagccaatgagagtccttttgctctaatagagaatttatttgatgtgaggtataaagggcaatattttgtcttcatgtaattttagaagcctcctctgtcagcaaggcagctgctgctattatccttaggaagtgaggccatccttatgcaaccatgtctaaggtttcataaaagtagctcacaggtcacttaacaggtcccagatcctgagataacactcctaagacaacttcctgcctctcagtgacatacagctggtagggtttctctgggtttggcagtcctagcacaggggctttagtcatagcatcctttagctgagcaaagtctgtaatttgctctttctccctgaggagggggccttgttctgggctgtcttttaggggctggtatagaggccttgctacttctccatattttggaatccataacctacaatacccagtcagtctgaggaatgctcagagttgccttaaagtggtagaggtggggatttgctgtatggcctgtattctctctggggctagtctcctctccccaggagtgaggatgagccctaaatagttaacttcctggcgaaccagctgtgccttcttcttggatactcggtagccacgttctgccaggaagttaagggttttgattaaatgctgaaggccagagtctcgagtggggaacagataagcaagtcgtctatgtactggagtattctcccacccccctcaagagataggtccttgaggtcctctggaagggcctgcccaactaggtgtggtgcatcccagaagccctgtagtaatacagtccaggttagctgttgctttaagttctgtctattgacccattcgaaggaaaataaaaactgacaggaggggtctataggaatacagaaaaaagcctccttaaggtctgagactgaaaaccatttagtccctggaggtacagggattgggcacaatagggtgaatgggtattactgcctcattaatgacccctaagtcttgaactaatctgtattctccatgtttctttttaacttgcagattggcacattgcttttttttttttttttttttttacaggcagagttagacagtgagagagagagagagacagagagaaaagtcttccttccattggttcatcctccaaatggctctacacccggtgctctgcaccgatctgaagccaggagccatgtgcttccttctggtctcccatacaggtgcaaggcccaagcacttgggccatcctgcactgcctttccaggccacagcagagagctggactggaagaggagcaaccaggacagaatccagtgccccaactgtgactataacctggggtactggcccaacaggtggaggattagccaagtgaaccacggcactggcccagattggcatattgcaaggggaattgcagggtgttaacaacccatgctttaggaacttgtccatttagtggctgtagaccttctctagcttctggctttgtaggatattgtttccaatttgggaaattattaggatccttaagttaataatgattgggcgggccttcaaggcccagcaaggaatgtctgaggcccaagcctgtgggttaacttgtagctctatctctttacatggtatgtcaggagacaggtgaggcatatggcagtagtaggagtttggccatcatcatgtgcagagaaagtcactcgagtccccaacttacttagaagttcccttcccaataggggtgtgggacactcagccattactaggaactgatgggaaaatatggccttcccccaaaggcaacataaagggggtgtgcacctccttagggaggggaccctgtgaccctgttgacttccattacttggctggactgtgaggagtgttggccagaataggaaacgagtacagaataggcagctcccgtgtctaagacaaaatttacggtcctacctgccacatcaactgcgactctaggctctgccccctcgatggtgatggttgctttgggaacctgacagagcaaagggctccttcagtttagggccaataggttttgcactcttgaaccaggggtcctttgactctcgggacagtctcgcttccagtggccaggctttttgcagagtggacagggctcctttggaagccggctgctgctacgacagcctcttgcccagtgccctggcttcctgcagcaaaagcagttaccacttggaggtgggctggccttgctgggtccctttgatggcagattaccacacaaagcagctatcaactgggcctgctgcctatccttacactcttccttttgtttgtctcgctcctcctcctcctggtctctgttaaaataaacagtagaagcagccttgataatgtcaaccaaggaggtgtttggtcccatccttaatttctgaagctttcttctaatatcaggggtggcttgagttaggaatctgtcccctagtacggcatttcctacagcagagtcaggatctaaatcagtatacttatcaagaccctctctgtcttttctagaaaggcagctggattttcctgcggcccctgttctatcattgacagcttattaaagttctttggtcttgccttactggctgcccttagacctgctagaagatatccagcatgtggtctctacctttctgtccctcaggagtgctatagttccatgaaggttccttaattaagatcgctacctccgccactgggtgtccctcatcttgcctatgcaaggcgtttgcataatcactgacatgctgcgacaccatctgcttttgcccatgagttaggatagtgtttagaaggaatgctatgtccttccatgtaagctcaaacataccagttataccatccctctcaccacctgttggggtcctcagtgaagcttcccatttctgttttcatctcatttaaatcctgcattttaaaggggacctgtatttttgtggggctattgggtcctaccacttcctgtaggggaaacattcctgcatcctccatgctcatgcccaggctcacgctcacgctcgggcttgggggttgacactctgagcaaggaagggctgttggctttacaggaggctgagggcgtgctggcttccaggcatctgtgggagcgctatcttgtggtggcagctcttttggcttagctttacagtgcatcctgatagtagatcaaatgaagttagcattgctgagtccagtttgcaactttgacagagctcatgatttttcctgagtgccaaaagacctgtacataagggatttctgtccatttaccctgctcacggcagtatagatatcaatgagaagtggtattagaatctaaagtcccacttcctggccacactctctgatcacctggtttatattgtgaccaaacgttgttacagagggaaactagcaattccttctttaagaccctggggttgaactgagatcagtttctgagaatgcatcctagtggtgagtcacgtggtggtaaggagagctggtttcccaattgaaagaaaataggggtgagaccttaatccactcaacttgaatatttcaaccaaagccagatccattcaaggctactgcaatcacccagtcaattaaaaacagttaactttagctccttcttagattcagttctcaggcaatcaaagcttagcaacaacaagagaaaatgcacaaaaaaacttttcaaggcacatgaaaactgccataagctgcaaagatggaaaacctatttgccaggttggagcaagttatctatcagatcaaggttttttccttccttgggtggagagacctgtggaatttccctctcccctcctggtggccagcagcatagcaatggagatgaggagaaacaaagagaggggaggagacagagagggaggaggaagggggaaaagtgacagaggaaaagatgtgatccagtgccctcaacttcatcagaaatctcagctgtgcctgtgaggcatctcaacgggaggagagcatagcgaaaggccctgatgtctgggggctagtgggtgttcagaatctcctatcgctcatgattgcccactacctagctgtctgagtttacctggagggccaatattagcctccatggaagctaagccctgctcatgtagcagtaggcagcatgaccaagcatccctccaagagagaggccaagtcctcgggtcgcagtccggctaccaggaagccaaagcaagctcagggggtctcctggctctctgccaactgcccttcctagttgccctcccattccttacaatctctctgcagtttcagctgtagctaagccgttaccaggggcactccatgttctcagagagctgtggggttccggatgatcaatggtcactcccacagatccagtcccactagagggaagggatgtctttttttctttctttttttgacagtcagagcggacagtgtgtgagagagagagagagagaaaggtcttcctttaccattggttcagcctccaatggccgctgcggccagtgcactgcggccagcgcactgcgctgagccgaagccaggagccaggtgcttgtcctggtctcccatatgggtgcagggcccaagcacttgggccatcctctactgcactcctgggccacagcagagagctggcctggaagaggggcaaccgggacagaatctggtgccccggccaggactagaacccagtgtgccggcgccgcagatggaggattgagccacggcgccggcctggatgttttcttaaaatcccttcctggtcgccagaaatgttgctggagaagcaaaggatcctagttttcacgccagaaagaactcaggcatgagacagagagtagtggaatgcaaaatagcaaggtttattagagtagggacatccctaaggatggatgggcacctctccagacaggacctgagagtgtggtagttcacatttaggctagggtttttaaggagatgggtcttgccttccctctccttctccttcttctcctcccgggacaagggacttgttggatataaatacaaaaaattcctttctgagttttccccctgaagttatcagacaggggaagcctggctggtgtcaccccgccttagaggaaggatggttatcaggtagaatgggcaggaccctggaaggtcacaggattcaggcaggatgtttgaagtgcaggtactgggctgcacctggaaggtgatcgggtagaaggggcaggaccctggaaggtcatcaggatcgggcaggactttgaaaggcagatatggggctgcacctggaaggttatcaggatgactttgagatgcggatgctggacctatatgtcacttccttaggcctttgtcacacactcataagctcatttctgacatcctacctaacactttctcatctcaagcacctgcgttctccttctgagtcctggtgtctctctggcagccgcttgttctgaggatgtttattctgagtcagtacagaggtgagtgtggacagaagtctcgtctctcagagaccatctccctggtgcagcggtctgccgtgaggggaaaacgtgagggcatcagaatacacaagaaaagacatggccctaggtgttaactattctctagaaaagtgactttctcccacagaatcccaacataaccatgaataaatgacaacaaattgtcctccagctcagttaaagtgttggtaaaagtccttcagagattttgggatgtcaaatcttatggtagaaacatgggctctgcagggaaacttgtgtagccctggtctgagctggggcagtggagacacagccccggggctgagttctgagctgccctgggcccttcagctgggcacagccctgccctgcccctgctcatttgcatgtccccagagcaccgcccacctctctgggcatttaggagcaggctgctcccgccccatgcaggaggcagtgccaggcaggacccagcatggacacgagggcccccactcagctgctggggctcctgctgctctggctcccaggtaaggaaggccagcagcaggaacggcctcgggcagtgtgaccagggctgcctgtctctgcaggagcgtcctcttagaacgtgaggatgagtgtggtctctgtgtttctctttcccttctcagg

SEQ ID NO: 146 - DNA, 3818 bp, Oryctolagus cuniculus
ccacagtgttccaagccctaacaaaaaccctccaggaaagcagaagtgtgaggctgggctgccccagctgctcctgggccccatctgctgagagtgattctcagagcagccaggcttgaaggtcctgcagggtcgggtggaaggggccaggctgactcctctgaggctccctcctttcctcctccttggtggcagcaacgcagacatgaccacgtccctactgttttcaagaatttgattattctttctgagtaattgaagttgtagtatcatttgagattcatagagcaagagagaaaacattatagatattacaaggaaatattttaaatactggtgtttagaaaattttataaaggataccaatttcatatttaaagtttttagtttttatagttacagttttttaaaatgatttatttgttattgaaagcacatggtttacacacacccacacacatacagagttaacagagagagttctcttccttctgctgattctcttctccagtgactgcacctgctgaggctgtgcctggcaagagctgggacatggaacttctttcaggtctcccacatgggtgtcagggctgaaacacttgttccatccactggtgtttcccaggccattagcagggagcttgtttggaagtggagtagcaggactccactggtgcgcatgtgggatgctggtgtggcatatggcagcttaacccactgcacaaggcctgcttatcctatgcacggttgtgagagcttaatgccacttcccaccatgtcgtccctcctttctcactcccaccaccactcttccttttttatttgtcttctctattttacaatgacatacttttcatttacttataatcaccagcttcaccctccactaaacaaagaattcaacccggagtagcagaaaaaccactgttcctcaagagtctatacacggctgtgagtctcttcctcccagtccctctgtcactaccagacctgaggtgcaccggctccccctgggggtcacaggtgaaatcgcgtctgctttgaatccctgcttgagcagttcttcattcaattcaaaatcaaatagcaaattctcatcgaattgaaccaatagtagcttcattgtttgcacacagtggctcacagtgaacagtatcacaatctcctaggcatagaagaattctaaaaatcgaacagagcccttaatttcctagatatctcatttcagtgggcagggtagatagtaaacaaacatcacctgctcccactctgggccatgtgagaggcctcccctggacactgccactgctcggggcaggtgggcagtgtgtgtcctggtccacttagtgcatcctcctgtcttgaggcagaagcagagggaatgaatccggcagttcaatttagtgtttgctgaacagaaaaactaatggtggtctcagtaatggtagaggaaactttgtcctttgtttgaaaaagaagctttttaagcttctcaaattgctgagtcatgaaaccagccaacacacaggtcagtggaagaatcagtgcctggaaactggctataaacagagaaacccagtttagcaaggatgtcttgtcctgtggttaatacttatttctagtgaagataattttcttaaatgttacccttttccattatttttaagatttattttatttatttgaaatatggagttacagagagagagagcgatcttccatcagttggttcactccccagatatgtaccatggccgtagctctgtcgatctgaagacaggagcttcttccgggtctccattgtgggtgcaggggcccagggacttgggccatcttcaactagtatcccaggccatagcatagaggtagattggaagttgagcagagggactagaaccggcgcccttatgggatgggggcgcttcaagccagggcgttaacacactgcgccactgtgccggcctcacccttatccgcttttgatatatttatttatttatatacataaaaagtgaggatcagtgagagctgaacacagagttggagagagaaagagagagcgagaaagagcgagagagagcgagagagagagatcttccatgtgctggtctttcccagatgacccttacacctgggctggaccaggccaagtgcagagccgagacctccaccgtggactgccagtgtatagcagggatccgagtacagccgttcccctcgaagtgtgttctaactattgctctttcatatcacaccacgccattagggaatgagagaaagcagaagcctctcctaccccagtgacgtccaccagatccacactgaggagctgctcagcttctccaggttctgggctgtgcgagccctgcagcccctgtcacaggtggagcagcagcagcaaagctgggctgagccgtgaggagagcgtggacctctacacacactggtcctctgtctgctgagaccccagagagacattctctgtaggagacctgtgcaacctgttatgatgtggacacctggtgtcacaacacatgtgcaggtgctgaggtgttggagagaattctcctatgtgaccgcgtatctcagagggcaggatgggctgctctaagtcccatggtgagtaggtgtggtgctgggatgtgaactcgggtctctaaaatacattcattctacaaagctggattcatgtcatggctgaggccagagttgaaaataacacaggatcaagcgcaggatggggtggaacacacagctcctacctgtctctgcctactcaaaatctggacccacatcttccacccagtacctcctgcagctgtgcccccactgccattctctcagagcctcctcaaccccaggggactgcatgtcagtgtggggcagggcctcctctgcatcccagactctttcctctcctcctccatcccttctcatccctcctctcatcctacctctcatttctctgcaacgacattttctcacctctgtgagacacagatcaaccaatcaaagcctcctcctccttctccactctcgtcctttgatagctgaccctgcggctgtcacatacctgcactgacaggaggtcatcagatacttacccaacagattctctctcagaggcactgtgtgctcgctcagcttacagtcagctgttctctgtgtgctgtagaatggaccccacgtgagaacacagtcacattggaggatatcagagcccagccactcactcaaaaaggaaaagacattaacttcacgttttaatatgtaaataatattttcttggaaaagggtctttagtctagagaatccaaatataacattgaatcaattaaaacaacttaccatccagttcactgaaagtgatggcaattgtccctcagtgaatttgggatgtgacatatcccggtagaagcatgcaactacgggtaaacgtgtgcagccctggtctgagctgggcagctggagacacagcccctggggtgagttctgagctgccctgggcccttcagctgggcacagccctgccccacccctgctcatttgcatgttcccagagcaccgcccacctctctgggcatttaggagcaggctgttcccgccccatgcaggaggcagtgccaggcaggacccagcatggacacgagggcccccactcagctgctggggctcctgctgctctggctcccaggtaaggaaggccagcagcaggaatggcctcgggcagtgtggccagggctgcccgtctctgcaggagcgtcctcttagaacgtgaggatgagtgtggtctctgtgtttctgtttttcttctcagg

SEQ ID NO: 147 - DNA, 6649 bp, Oryctolagus cuniculus
ccacagtgatacaagccctagcaaaaaccccccaggaaagcagaagtgtgaggctgggctgccccagctgctcctcctgggccccatctgctgagagtgattctcagagcagccaggcttgaaggtcctgcagggtcaggtggaaggggccagggtgactgctctgagaccttggtggctgctatacagaccaggtcatgtccaactatttaaaggaaagaaaatattctactggagtatttggtatatactatcattttggattcatagagcagaagagaaaaatattatagaaatggcaagaaaaatattttaaatctaggtgagtggagtcttcacatgccctcaacgtcctgggagaacggccgtctgagagggagatcgtagacacagagactctcagatctctcctagaggccaagcacctctggggcagaaggcacaggtgctgcccctcgtgtcctcagccctgtccaggaagccctggggtgggggcgctggtgctctctctgcctgaagcactcacacgtgattctcccccgcccctctgttcccagtttgcctgcaggagctgattgacagaggagaattctgcttgtctcatggtcaaatctcagcgccatggatggtgtgtgtgtagtgtgcaatggtgtctgaatatgcaggcgtgattctacccaggtctgtacatctttctgtattttccttccacgcagcagtgtttcctctatagaggaggccctggcttgcacagcaggacccgaggcacaaccaggatggtgtgagatgcaccgttcactgcacacctgctcagtccatgttggctcaaactgccatgcagccccttctgcagtttggtcaccaaacacagttctctcacaagcatttcacaccgctggtgacgttgtttcagattctgggaaagtaagagaagttgtgtttcctaaccttcctcatctcctctgtcccttctcatcctgggtcagtgctgcccctcatggtcaccgtgttctaatccctgccctcagtatggaaactgatacacggatacaaagctcttcttccactcaggttcctgcttgggagccctctgccatcacataccgagaccgaagagagatcatccaaacgtttcacccagcagagttgtatctaagaggaatgctgtgctaactcccctcacaataaactgctgtttgtctcttgtcaagacacccaatgggagcaaagagaacactttgggatgtcagagcaggaccagggaggaggtgaaaggcgttatcttccttggtgtttgcttggtgcattgttgctgtaatgaattattccattctcttcggctcagacaactgcacgtactgttgttgtggtcaggagcttagtgctgtcgctgtaagaaactccaggggcagcagggctgtggtgttccggatgctcccgagcatgggattcctttccaggtttgtccagcgtcaggatggccacatttcctgctctgtggcccctcctccctcactccacagcctgctgccctgtcacagcccctggaccctagccctcctcccgacttcaggaccattgtgatagtatggatcccaccaggtccttctgggacatctccccaccacagtccattgcctaaaatctccattatgatgcggcacctgggggaagttccaggggagtgtctggctgccagggttaagctacctaagatcagaccaccagcagggatcggtcagctttagttcaggacacgtggacagtgtgtgatccctatactttgcttaaggtttgctgtgtgtgctccacgcgcctgcatgacctttctgctgattgactcccctaccgcacatatcttttgtaagctttataagcctgcattcttcttcaataaggcggttcctgcttcgacagaactcacgggtgcttgtggtgtgttcatcacctgtcgacctcacctctcccgttcgccttttggggagtgcctgcgctgcccctgctggtcagggctagcatcgggcttgagaccccgacacccatctttaaaacataagtctcagattaaaaaaatagtgtaaagatttccttgtgtggggaatcccacaggagtcccaaagacgagccatggatcaccgcttacccaacaactaataggaggtagaccctggagaaattcatggtagtcccaaatgagtcacacagcaccgctaaccacaaatcaactaaaacaagaatggagttactgatgccaagctaggagctgatgacaccacgtgtgctaagtttagtgtctgccaagaaaagcctctcctcatcagactgaacagacgccccggacagtctgacaatgtgtgtgctaagacggtaacctgaagtcccccaacaatagcatggtgactcacagcaccggacacagctgatcctccctgtcttacacagcagatcagcggtgccccgggaaattccagaacgtgactgattgactcccggacccccaccaggggccttcccccctggagtggcaaggataaaatgagagctcttttcactgctccccaccccctcagggatcatggcccagtacgtgggaacctctggatctcctggtatgtggagctgaaaagccagctcactactctgcagcggcacaaggcgactacgggaccaacctccatcagagccgacacctcgacacctctcatcagcctgctgctggaccggacagcagagctggaccagaactctcagcaggggacctctccaactcctcgccttgccggccgcctgggaacttggagcctactgcccagagacagtcatcccacgacttcctgcctgtgactgttctgagatccgtttcttgagtgctaacggagacttcggactttgacttcgtgaccgtgatacaaaccttgagaatgcaacatttataatgatattagccacgtggaatatgaaggaatgtgcctcgaccgcatgattaagaataatgccatatgcctgccgtacttacatccctatagttggattgccttagagactgcctttatgatgtgtgttaggatctgtggattaatgaatataactatatagattggtatgcagagtggtgaagccctagtgtgaattggtgtgaacaataaaaacctttcattggaaagacagtctgtgtccatgtgttccttcttcctggtactccgacacttcgcccttaagccctgtcgagcggcatgacagtaggtgctcacgacaccttgaaaactcctgtgctggtgctggcactgtggcttggcggcagccaccgtgctggcatctcatatgggtgctggtttgagacctggctgctcaacttctaatccagctccctaatatgacttgagaaagcagaggaagatggcccaagtccttgggcccctgcacctgcatgggagacctggaataagctcctagctcctcactttggattggcacagatctggctgttgtgaccaaatggggaatgaaccagcggtataggtgatagctccagagaagcagcctgcgggcattcctaatgctttgtgcacttgcctctaagtctagaataagccccaatgaaacatggaaatgcatacagaactgttagttcttccataattttattaatcaacttacatgaatttaacttattttaatgcaggcaaagtatccattctttgtctatttttaaacagatttatttatttagctgaaagttaagagtcacagagaggcagaggtagagaggcagagatagagagagacagagagagagaggtcttccatccactggttcactccctggatggctgcaactgggggatctgccccatccaaagccaggagccaggagattcttcctggtctcccatatgggtgtaggggcccaaacacttgtgccatcttccactgctttcccaggctttagcagagagctgaatcggaagaggagcagctgagactagaaccggcacccatttgggattccagactgcaggcagtggcttaccccaccacaccacagtgctggcccctagtttcatttttttaaatatatttatttgcttatttgaaagtcagtgttacacacatgcacaaacacacacacacacacacacacacacacagagatgagagatggagagaagagagagatcttccatctgctgttacactctacaaatggctgaaatggccaagactatgttaggccaaggctaagagccagaacttctttcaggtcacccacgagtgccagagcccaaacacttgagatatcttcagctgatttctcaggctattagtatggagctggattggaagtggagaagccaggactccaacaggtgcacatatgggatgtggctttatcaactacaccatagtgctggctgtcatatacacattttgagaattcatgatactttgagccatattctccttccttcctcactcccaccctactgctcttctttttttttaatattttcaattaagttttatgacatactttcaatgtactttataaacactatctcagccttccactaaacaaagaattcaatgaggagtgagcagaaaaaccactgttcctcatcctatagacaaggctgtgagtctcttcctcccagtccctctgtcactaccagacctgaggtgcaccggctcccccagggggtaactggtgaaatcacgtcagctttccatccctgatggagcagttcttcactcaatacaaaatcaatagaaaattctcatcgaattgcaccaatagcagcctcattgtttgtatccatctgcacaaaaataacagtagcacaactttaggcatagaataattggggcaagtcaggcagggcagataataaaccaatgacgttctacctctgctccctctcggctccacggtagaggcctcccctgggcagcacgattgctcaggacaaggggcctgtgggtgtccaggtgcatttgtgcatcctcagtctcagcctagacagggactgaggcagagaaacgtatcagtcagttctacacttgtgtttccaggaaaaagctaaggtgtggtctcagtaatggtcacagagccaaagcatcctatgattgctgaaaaagtttttcaatgttcacattcctgtagcatgaaaccaggcaacacacaggtcggtggcaagaagcagtgccctgacactggagctaacaacaactggagcccagttttgagagggcgtcttccactgtgtttaagttatttctagtgatgttaactttcttccatggtaccattttctatttttcaatacatttatttacctaaaacccaagcattgtagagaaacaaagaccaagagagattgagaggaacagagaagaaaggagagagaaagagagagagagagagagagagagagagaagacagtgagaaggcaagagagatagagataaatatgttctttaacctggtgcactctacaaatggctgtaacagtgggttcctggccaagcagaaggccagagccagatctgcccctggatggtgcaagaatccaagaacttgggccatttgctgctgcctcccagggtgggcattagcaggaaatgggatcaaaagtggagcagtggggattcaaaccagtctctgatgagggctgctggcattgcaagtggcagccttacccactgtgccctgatgccagccttccctcctctccggatttcttaagaaaaacctgaagtgttccagaaaggggagagaaggaagttatttttcatgatgttcctcaaaccattggtgactccttgaaactttcacttatcttttcctcctgtatccctgactcagaactcagctgcagaagggagagcgcacctgtgtgatgtctcctctaagcacctgcgttctccttctgaatcctggtctctgtctggcagccacttattctgagtcagtacagaggtgagtgtgggacagaagtctcgtctctcagagaccatctccctggtgcagcaggctgccgtgaggggacaacgtgagggcatcagaggacaagcaggtatagacatggacctcaggcttaaagtgttcactattcattagaaaagcaactttctcctccagaatcccaattaatcatgcatagataatgctatcttgttgtccagttcatttaaggttgttacaagtgtccttcagtgacgttgggaggtgacgtcttccaaaggaaacatgcacactgcatctaaacgtgtgcagccctgatctgagctggggcagctggagacacagcccctgagctgagttctgagctgccctgggcccttcagctgggcacagccctgccccgcccctgctcatttgcatgtccccagagcaccgcccacctctctgggcatttaggcccaggctgctcccgccccatgcaggaggcagtgccaggcaggacccagcatggacacgagggcccccactcagctgctggggctcctgctgctctggctcccaggtaaggaaggccagcagcaggaacggcctcgggcagtgtggccagggctgcccatctctgcaggagcgtcctcttagaacatgaggatgagtgtggtctctgtgtttctctttcccttctcagg

SEQ ID NO: 148 - DNA, 7241 bp, Oryctolagus cuniculus
ccacagtgatacaagccctaacaaaaacccccgaggaaagcagaagtgtgaggctgggctgtcccagctgctcctcctgggccccatctgctgagagtgattctcagagcagccaggcttgaaggtcctgcagggtcgtgtggaaggggccagggtgactcctctgaggctccctcctttcctcctccttggcggctgcagcacagacgtgaccatgtccctactgtgctaaaggaaatcaactattctttctgagtattcaaagctggacatcagttgagattcatagaacaaaagagagaatactacaattattacaaggaaaactattttaaatactggtgattataaaattttatgtaagaaaccaatttcatatctacagcaatttaataaatttcatttgctttttgaaaggccatgttttacacacccccccccccacacacccacacacacagagtttcatagagagagacgtcccttccatctctggtctctcctccaatggctgcagtggctgaggcagtgcctggcaagacctggagatggagcttctctcaggtctcccacacgggtgccagggctccaacactggagccatctacaggagctttcccaggctaagcagggagctggagtggaagtggagcagccagaactcccaccggtgcccatgtggatgctggtgctgcctttggctgctttgcccactgcacaaggctggcccatcctgtccactcttgtgagaaataatgcctcttcccaccatgccctcccttcttcctcactcccacccactcctctctttttcttttaagttttacatggacacacgttcaatttattaccaccaggttaaccttccagtaaacaaagaattcaatgaggagtgagcagaaaaaccactgttcctcagagtctagacaaggctgtgagtctcagtcctcccaattcctctgtcacagccagacctgaggtgcactgcctccccctgggggtcacaggtggaattacatcagcttttaatccctgattgagcagttcttcatgcaatccaaagtcaaatagaaaattctcatcgatttgaatcaatagtagcttcattgtttctacagactgcatatgactcacaatatcaaatctcctaggcatagactatttgtaaaaagctgagcagagcccttcatctcataaatctctcattttgtaggcagggcagatatgcgtggctcactaggctaatcctcctcctgtggcatcggcacaccgggttctagtccccgttggggtgccggattctatcccggttgttcctcttccaggccagctctctgctgtggcctgggagtgcagttggggatggcccaagcttgggccctgcacccacatgggagaccaggagaagcacctggctcctggctttagcacaccggtcgtagtggccatttgtgggttgaaccaacggaaggaagacctttctctctgtttctctctctctctgtcactgtctaaatctgcttgtgaaaaaaaaaaagaaagaaaaagaaagaaacatataatgtttctatacctgctcccactctgccccacatgagattcctccccaggggcactgccattgcttgggcaagtgggaagtgggtgtccaggtcctcacagttcattctcctctctcggggacagaggcagaggcagaggcagagggagggggatcttaccatgcagttcaacatttgcccttcatgaaaaaataaactaactaacagtaatggtcagatggccaagttgtcgttggattgaggaaaaaggttttaaatttctgaaatcgctgaggaatgaaaccagctaacacacaggtcagtggaagaatcagtgcccagttggcctgagctatggcctatcaggtatgctacacctgcagtgccagcatcatctatggggctggttcaagtcctggctgctccctcagatccggctctgtgctgtggactggggaagcagtaggagatggcccaagtccttgggcccctgctcctgcataggagatctggagaaagctcctggctcctgattccttgctcctggcttcggattggcacagctctgcccattggaaccaactggggactgaacaaatggatggaagacctttctctctctctctctccctctctgcctctctgcctctccttctctctgtgtgtaactctgcctttcaaaatatatatatatatatatatatatatttacttgaaagacagcattgctggaaaatgaagtaagagagactgagagggagttgagagggagagagagagagagagagagagatagattctgttcattggtttactcccccaaaggccaggctgaagccagtagcccaggactccacccaggcctcccacgtagatggcagggacccaggcacatgagtcctcactctcagggtgcacatgagcaggaactggcatcaggagcagactgggattagaccaggcactcagtgtgggatgtgagcaacccaagagccaggctgatgctgggggtcagggactccatctgggcctatgtggggggcagtagcctcctgaccacaaaagagcccagggccctgttaacgacttcctcaacctgcgtgcatgctcagaatagcgcaacgtgaccaatatgtgaccttcctggggtcagcaacactgccacttggagcgtgtcatgggcgagatagctaacagctcccacacagcgcagagctgggtgcacactgaactgttgtgggtcaagggagacgagctgcaaccacaggctgggtcctgatctaggtgtcgtgtgcctcgagaaactgctgtgtctccccaagtccatagaagcaggggcttagctcccgtcgggggaccagttggaggactcgtgcctgctgtgctccctccccgtgctcctgcgcaagaccacaggaaacctggtctgcactgcaggtcaccctcttggtaatttctattttcaagtgagtccaggaacctgggctggcagcaaaaccctatcacccatggcccctccttagaaactccaaaatattctgataagagaaatgagtgcagagaatccctgacgtgctgtcgtctccagttggaatcaggttatgaggctctgccagcagacggacccctgcaatttgcccttgtctcattcctggtgcctcacatgctctgcccatgtccccaggcacagccctccgacttgggacttttaactcaaccttgtagagatctagggctcagcaccattgggcagtgcaggagcggcccgggaatgtcactggtcctggtgtttgggcatccgttgttctgtgtgccaggtgaggcgaatgagccaaatttcagaaatagaatgaatggttcttccagtgtgacttgtgtctcgttcttttgagatgtgacacaggttaagcgtcccagcattgctgatttctgcagttctggcattgaggaggtgagttattgttgttgttttctttctttctttctttctttctttctttctttctttctttctttctttctttctttctttctctctctttctttctctctctctctcccttccttccttccttccttccttccttccttccttccttccttccttccttccttccttccttccttccttccttccttcctttctttctttctttctttctttctttctttctttctttctttctttctttctttcataaaccaacttcctcaccctacaggttcagtctgtctgtgactgcaggtccgaggagcacattgatcttgcttgaactttaccattacagattgtgttcccagaggaagtcaacaacagctccctgctggtcggatcaaagaatcccctactgtggtatcagcacctgcctggactgtctccttgctcttggtcacagcatttgacagagtccataggctgcctatctctttagaagcctggaatattcactcagaaacacactggaacctagaaaaatctgaaacccttagttctacgaacaggaacagagtgccaagctgtggcaggccattctcaggatcaagcaagaggagatggacttgatgtgggaatttataaacaagtcattttagtaagaaatcatcatgtttatctagtggagaaggagacagagaggttcaggttgagctccccaagttgtcttttttctggtttgtatctggttcttgattcaagttggctgagagacagatattaccctctgcagggtagaagctgaaaatgctgtaggctttgctgtccctcccaggggactggggctaaggcagaaacctcccaggggaggccattcaggcaagttcaactgccagggctgcttctccttccctggagctcccacgttactctaaacacacacgtgtctgtgtgcccagcttgtctatgtgactactcggtcggagacagagacctccgagctctttctatattaccacctccttgtttctgtcctgaacacatttggtgtttccttcgcttttgcagctacaaacaaacactctcgtattgatcttttctctccagccctgacttccacacgatctctcactcggactcttgaaatttttgtgatttttttcaagggtcataaacatcaatttatgcaaccctagtgattgtcccaaagtttagaaagaggaatattggccatgaaagagccccatgtagcagtgagattttctttccgtagtggcaaaggggggcagagtgactgcaccacagcttatctttctcacgtattacagctgagatggctgcaatatggaatataggaaggaaatgcaggagatgctgataagcaaacattagcaggaaaatataggaagaaagacaaaatgcgaatagcccacaggtggtgagcttcctggggactgctgtggtttggggatgttctttgtggttgggtggttggttgacgggttttattggtaaatttctctctgatcttgggtctcaggattgactaaattaagcaatgtcctactgggtaatggatacggacaaccaaaatcaagggagtctgtctttgcagtcataggactaggaggagggctgctaggctgaggagcaggaggaaggagccttgtttcattcttcattcctcctctctgcattcctctcctgtatctgtcatgggtttctcaaaccaaaattacttagtaactggcgtttttcaagtctgattaaaactcataatcatgagagccatgacgtttttttttttgacaggcagagtggacagtgagagagagagacagagagaaaggtcttcctttgccattggttcaccctccaatggcagccgtggccagtgcgctgcggccggcgcaccgtgctgatccgatggcaggagccaggtgcttttcctgctctctcatggggtgcagggcccaagcacctgggccatcctccactgcactccctggccacagcagagagctggcctggaagaggggcaaccgggacagaatccggcgccccaatcgggactagaacccggtgtgccgacgccacaggaggaggattagcctagtgagccgcggcgccggcgaggcatgacattaatatgtattctcatattgcaagctggtctctctctctctcttttaaagatttgttgatttggaagatgtagtgacagagagaaggaggagggatggagatcttatattggtggattcactccccagatggccagagcagagaactccatgtaggactcccaggagtgtggcagggatccatgcacaggcgttccttataaatcatacccctccagtgtgttctattcattgcacctttatcatactccaaggcaattagggaaaaacagaaagcagaagccgtcctggcctcagtgacgtccaccagtaccacaccgaggagctgctcagcttctccaggttctgggctgtgcaagccctgcagcccctgtcacaggtggagcagtagcagcaaagctgggctgagccgtgaggagagcgtggacctctacccacactggtcctctctctgctgagaccccagagagacattctctgaggaaacctgtgcaacctgggtctgatgtggacacctggggacactgtacctgtgcaggtgctgagggattggagagaattctcctattgtctgcatctctgcaggcagggagggttacccatagtcccatggtgagcaggtgcgtgtgctgggatttgagctcaggtctatataacattaaatccattccatccacatggctgaggtcatcctatgtctgagaccagagtttaaaataacacaggagacaagcccaggattggggggacacacacgctcctcgctgtctccacctcactccacggggacccacatcttccacccagtccctcctgcagctgtgcccccgactgccattctctcagagcctcctcaaccccaggggactgcatgtcagtgtggggcagggcctcctctgcatcccagactctttcctctcctcctccgtccctcctcatccctccactcagtcctacctctcatgtccctgtacatccaattactcccctccatgcagacacagatcaaccaatcaaagcctcctcctcctcctccactctcgtcctttgatagctgaccctgcggctgtcacatacccacactgacaggaggtcatcagatacttacccaacagattctctctcagaggcactgtgtgctcgctcagcttacagtcagctgttctctgtgtgctgtagaatggaccccacgtgagaacacagtgacattgggaggatatcagagcccagccactcacccaaaagggaaaagacactgacttcaccttccaaggtgtgaccaggtgttctctagagaaaggactttctcctacagatccccacctaaccatgaatacgttacactaccaggtcgttcagttcacttaaattgctggaaatgtccctcggtgagtttgggaagtgacatctcccagtagaaacacggtgccaggcaggacccagcatggacatgagtgcccccactcagctgctggggctcctgctgctctggctcccaggtaaggaaggccagcagcaggaacggcctcgggcagtgtgaccagggctgcccgtctctgcaggagcgtcctcttagaacgtgaggatgagtgtggtctctgtatttctgtttccctcctcagg

SEQ ID NO: 149 - DNA, 3799 bp, Oryctolagus cuniculus
ccacagtgttccaagccctaacaaaaaccccccgaggaaagcagaagtgtgaggctgggctgccccagctgctcgtcctgggccccatctgctgagagtgattctcagagcagccaggcttgaaggtcctgcagggtcgggtggaaggggccaggctgactcctctgaggctccctcctttcctcctccttggtggcagtgcacagacatgaccatgtccctactgttttcaagaatttgattattctttctgagtaattgaagttgtagtatcatttgagattcacagagcaagagagaaaacattatagatattacaaggaaatattttaaatactggtgtttagaaaattttataaaggataccaatttcatatttaaagtttttagttttttatagttacagttttttaaaatgatttatttgttattgaaagcacatggtttacacacacccacacacatacagagttaacagagagagttctcttccatctgctgattctcttctccagtgactgcacctgctgaggctgtgcctggcaagagctgggacgtggatcttctttcaggtctcccacatgggtgacagggctgaaacacttgttccatctgatggtgctttcccaggccattagcagggagctcgtttggaagtggagtagcaggactccactggtgcgcatgtgggatgctggtgtggcatatggcagcttaacccactgcacaaggcctgcttatcctatgcacggttgtgagagcttaatgccacttcccaccatgtcgtccctcctttctcactcccaccaccactctcctttttttatttgtcttctctattttacaatgacatacttttcatttacttataatcaccagcttcaccctccactaaacaaagaattcaacccggagtagcagaaaaaccactgttcctcaagagtctggtcaaggtgtgagtctcttcctcccagtccctctgtcactaccagacctgaggtgcactggcgccccctgggggtcacaggtggaatcgcgtctgctttgaatccctgcttgagcagttcttcattcaattcaaaatcaaatagcaaattctcatcgaattgaaccaatagtagcttcattgtttgcacacagtggctcacagtgaacagtatcacaatctcctagacatagaagaattgtaaaaatcgaacagagcccttaatctcctagatatctcattttagtgggcagggcagataataaacaaacatcaccagctcccactctgggccctgtgagaggcctcccctggagcactaccactgctcggggcaggtgggcagtgtgtgtcctggtccacttagtgcatcctcctgtcttgaggcagaagcagagggaatgaatcggcagttcaatttagtgtttgctgaacagaaaaactaatagtggtctcagtaatggtagaggaaactttgtcctttgtttgaaaaagaagctttttaagcttctcaaattgctgagtcatgaaaccagccaacacacaggtcagtggaagaatcagtgcctggacactggagatataaaagaggaacccagtttagcaagggtgtcatgtactgtggttaatacttatttctagtgaagataattttcttaaatgttaccctttttcattatttttaagatttattttatttatttgaaatatggagttacagagagagagcgatcttccatcagttggttcactccccagatatgtaccatggccgtagctctgtcgatctgaagacaggagcttcttccgggtttccatcgtgggtgcaggggcccagggacttgggccatcttcaactagtatcccaggccatagcatagagctagatcggaagttgagtagcgggactagaaccggcgcccttatgggatgggggcgcttcaagccagggcgttaacacactgcgccactgtgccggcctcacccttatctgcttttgatatatttatttatttatatacataaaaagtgaggatcagtgagagttgaacacagagttggagagagaaagagagagcgagagagcgagatcttccatgtgctggtctttcccagatgacccttacaacacctggggctggactaggccaagtgcagagccgagacctccaccgtggacttccagtgtatagcagggttccgagtacagccgttcccctcaaagtgtgttctaactattgctcttttatatcacaccaaggccattatggaatgagagaaagcagaagcctctctggccccagtgacgtccaccagaaccacactgaggagctgctcagcttctccaggttctgggctgtgcgagtcctgcagcccctgtcacaggtggagcagtagcagcaaagctggtctgagccgtgaggagagcgtggacctctacccacactggacctctctctgctgagaccccagagagacattctctgtaggagacctgtgtaacctgttatgatgtggacacctggtgtcacaacacatgtgcaggtgctgtggtgttggagagaattctcctatgcgaccgcatatctcagagggcaggatgggctgctctaagtcccatggtgagtaggtgcggtgctgggatttgaactcaggtctctaaaatacattccttctacaaggctgtattcatgtcatggctgaggccagagttgaaaataacacaggatcaagcgcaggatggggtggaacacacagctcctacctgtctctgcctactcaaaatctggacccacatcttccacccatccctcctgcagctgtgcccccgactgccattctccagaacctcctcaaccccaggggactgcatgtcagtgtggggcagggcctctctgcatcccagactccttcctctcctcctccacccttctcatccctcctctcatcctacctctcatttctctgcaacgacattttctcacctctgtgcagacacagatcaaccaatcaaagcctcctcctccaccctcgtcctttgatagctgaccctgtggctgtcacatacctgcactgacaggaggtcatcagatacttacccaacagattctctctcaggcactgtgtgctcgctcagcttacagtcagctgttctctgtgtgctgtagaatggaccccacgtgagaacacagtgacattgggaggatatcagagccccgccactcactcaaaagggaaaagacattaacttcaagttttaatatgtaactaatattttcttggaaaagggactttagtctacagaatccaaacataacattgaatcaattaaaacaacttaccatccagttcactgaaagtgatggcaattgtccctcagtgaatttgggatgtgacatatcccggtagaatcatgcgcactacgggtaaacttgtgcagccctggtttgagcaggggcagctggagacacagcccctggggtgagttctgagctgccctgggcccttcagctgggcacagccctgccccgcccctgctcatttgcatgtccctagagcaccgcccacctctctgggcatttaggagcaggctgctcccgccccatgcaggaggcagtgccaggcaggacccagcatggacacgagggcccccactcagctgctggggctcctgctgctctggctcccaggtaaggaaggccagcagcaggaacggcctcgggcagtgtggccagggctgcccgtctctgcaggagtgtcctcttagaatgtgaggatgagtgtggtctctgtgtttctgtttccctcgtcagg

SEQ ID NO: 150 - DNA, 6480 bp, Oryctolagus cuniculus
ccacagtgttccaagccctaacaaaaaccccccaggaaagcagaagtgtgaggctgggctgcccagctgttcctccttgggccccatctgctgagagtgattctcagagcagccaggcttgaaggtcctgcagggtcgggtggcagcgaccagtttgactcctctgaggctccctcttttcctctccttggaaccatcagcacagacatgaccatgttcctactgttttaaggagagcaattattctactggagtatttgagtgtattgtatcattttgaattcatacagaaaagataaattattatagatatggcaaggaaaaatagtttaaatcctgatgagtgcaatcttactatagcttttaatatcctgggagaacggccgtcagagaaggagatcttggacacagagactctcagatctcctagaggccaagcacctctggggcagaaggcacaggtgctgccccgcgtgtcctcagccctgtccaggaagctctggggtgggggtgctggtgctgtctgcctgcagcactcactggtgattctcccctgcccctctgttcccagcttaacctcaggaggtattgacagaggagaattctgcttgtttcctggtcaaatctcagagccatggatggttggtccagaatgcaatggtgaccaaatatgttggcttgttccaacccaggtctgtgcatctttctgtattttccttgcacattgcaatgttccctctacagaggaggcccctggcttgcacagcaggacccgaggcacaaccaggacggtgtaaatgcaccgttcactgcacccctgcttcagtccatgttggctcacatttttcatgcagctccttctgcagtttggccaccaaatacagttgtctcacacgcatttcacaccccaggtgacgttgtttcagattctgggaaagtgaatgaagtcgcatttcctaaccttcctcatctcctctgtcccttctcatcctgggtcagtgctgccctctcacggtcaccgtgtcctaatccctgcccccggtatggaaacagatacacagatcctaagctcttcttctactcaggttcctgcttgggagccccctgccgtcacataccgagactgaagagagatcatccaagtgtttcacccagcagatttgtatctaagaggaatgctgtgccaactcccctcacaataaactgctgtttgcctcttgtcaagacaaccaatgggagcaaagagaacactttgggatgtcagagcaggatcagggaggaggtgaaaggcgttctcttccttggtgtttgcttggtgcattgttgctgtaatgaattattccattctcttcagtcacaatattgcatgttctattgctgtggtcaggagctcagcgctctcctggaagaaacccgggagacagcagggctgtggtgttcttgtatctctcgaggatgggattctgttctaggtttgtgcagtgtctggatggcagatttcctgctctgtggcctcccctccatcactccacagcttgctgccctgtcacagcccctggccctcctcccgacttcaggaccattgtgattgtaccgctcccaccaggtccttctgcgtcatctccccatcacagtccttaatcagccaccctgcccagccccttagatggcagacctggcgagaagggagtaggctgcggatggcttctgtgttggagacaatttgtgtctgtcttacactcttaccatctctgccactgtctcccctgagacagaattagagctgatagggcagatctcggagcaacagagttggaggagatctagaccgaggtgctgtgacatgtgtgttggagggggcggggaattttaatgctgcctctaatggggacttagtggagcccagctgcctggcagagtttgataaatgcagtgtggttttagaactcagaatctgatgagcgcccaaggaaagagtggttgttccccaggctcatgcctgttgtaagccagttggatgatgctcagttggggtctttttttcagatttatacatttatttgaaagagaattagacaaagggaaaagaagcaaagagagatagatagagagagagagagagagagtgagatagaggtcttccatccgtggttcactcccctattggccccaacggcctgggctgtgtagatccaaagccaggagccaggcagagttacagacagagtaagggatagacaaagtgcaaggtttccatctgctggttcagctcccaaatgttcccaatgcccagggcctgactgatccaaagccaggagccaggagtttcttctgtgtctcccatgcaggtgcagggacccaagcacttgggccctcttccactgctttcccaggccatagcagagagctggatgggaagtggagcattcaggatatgaaccagtgcccagatgggatgctggcactgcaggtgaggattaacctactttgccagagcgtgggcccctcaactgcacccttacacatcagctacaatttgtaaacctagatgacttgtcacagaatccaggtgattgtgaacagaaaatttagaattttaattaaacctcctggacaacttctgaaagtacatgaaaagaatgaggagaaatgaggagataagcttgtttttctgcaagaaatttcaaaactgtgcattattttttcattatatggattttccctgtcttttgaagattgcttgttattgtggcatgagtacacggaaggtgtgagtgctgctgggtagaacaaggacagcaggtgcacaccgctgtctctcggagtctctgatctctgtgtggaccccactcctctgggacaagcgaagcagcctcgggacatccacagctgccctctgtggtttctctgcacaaactcatctcggagcacgaggccccacacacaggtcagtccctcttgtcacaattctgtagggctgtctctttgtgcttaaaaatattcaaattgcttttaaagctgtttatgctacaactaatctggagcccgtggtggggaaaacagtggaccggaaggcaggagaggagaagtctgaaaagctgaagcgagctggagccccagggtaacggaggggaatgttgcaggtgcagtgctgggaagccatcagccgagaggaagctgagccctcccaacaaaacctacagagatctgcaggtctgcattggccacaggtgggcagatgtccaagacagcgtcagccacatgcgccagctgggtcaataagcctgcagagactgctccacctctggctgcaaacgccctctcaggagcagggcttgtaatggagatgaagatggggaaccggagcagaggcctccaggagccaaggtgaggatgaggagccctggaaggattcgccagcatcagccaacacatccctgcaggagggaaagcacgggttttctgagagcagaggctctgggaaccagatatcaaaccttatcctggaaatggccatgaccaagacaactgaatgacgcatttattaattggggttgggtgtggggtgggcgtcaagttgaaagtaacaggttcccttttgaaagaatggtattgtgtacctgctcgtcagctgaaatagagtattacaataccagtgacagtcacacaggattttattgaaaatgagaagcaactgagagacacacgagaggcaaggtaaccgatcaggaccggccactaattgggaccagcacgtctcaaaagagtgcggcccccaccagcggcttacacagctttttatagtattctgtccactagggtaaacaacttcaaaccggacccctggaatgcagtgaacaataaaaaggataaccagaatagggttgtaaaataacagttatcaataacaaacccaggaacacacccaagatatggttgtaagataacagtgagggacacatttcagtcaacctagttcctgggaatttgggcccacatagtttcacaagatgcacccttggctgttagcaagcaaagctaatatgtacagaagcaagagatctgcagttagctattagccacactcactgcatttggattctgattctacaatataaggctgtctttggagccactttttttttttcattttttcctaagattgagtggcacactaataaatgagagcttgaaattcgaggtcatttatgttttatacacagctttcagacatttgctgattttgtagctttgtgtgatcagtttccaaaggtgatagataataaagaagtcagaatggcacctgttaaagaattgcagatctttagacattactattagcacatccagagggaagcacaactttgttgtctacttaaagctgtgagtagttaactctctgaactccctccttccctgaactgacagcaaaccagagtagctttctacagagaagggggtattgtactgagaaaaaaagttacctctacctgaaactaaactgagataaagttaaatacagcctttttcttcatgggcatttgttttgtttgaagtcaccataaactcagtgttgcattgctgtcagtggataccacagcttagctctttaaaaaaaataactttttaggtcaactatggagtatttgaaatagcctacttcccttaaggggtcttgtctgccttcctttgtcctccaagacaactgtttgctaccaaagtgaatccgtatttccaatgtgcttctcttggtctttgattattagctagttcttgtaggcagttccactggaacttgaggcaaatcagaaggaagttgattcttttaacatagaaaccctcaccaaaaatgtatatgtgtatattgctgaaaatatttggctatttaaaacatttttaaatgatataaacaccaaaaaaatgaacaatgtgtaagatggaaaatgaaaagatgcactgtctgtaactttgcacatttaagttactaagttgtaaatcaaatttggattaaattcactacatcatcttatttttttttttctagatttatttatttacttcaaagtcagaggtacagagagagaaggaaaggcagagtgagagagagagagaggagagagagagagagaggtcttctatccaggtgtactcccctatgggcctcaacagctggatgtgccaatctgaggccaggagccaggagcttctcctaggtctcccatggggatgcaggtcccaaggactgggccatcttctactgcattctcaggctatagcagagagctggatgggaaatggagcagccatgtagaacctgtgcccatacagaatgctggcactgcaggtggcggctttacccactacaccacagcaccggccgcctccaggtcctttattagtgcaattatatcatttaatttaagagcatacagattgatcagtggcctctccaaagcacattttaggcactgaaatatagataaaacacatcttcaatcatattgtatggagttctcaccacatatactctgttagatttgtgtttagtgggctctctagattatcttaagaataacgtgagatttcaggatagaggagagagggcagttacttttcttgatgttcctcagagctatcgtgacaccttgaaattacacttattgattcctcctgtatcctggactcagaactctggctgcctaagggagagcgcacgtgtgtgatctctcctcaaagcacctgcatctccttctgagtcttggtctctctcaggagcaacttgttctgaggatgtttattctgataagattcagaggtgagtgtggacagaagtctcgtctcttagagaccatctccctggtgcagtggtctgctgtgaggggacaatgtcagggcatcagaggaaaaacaggtaaagacaatgacctcagccttaaattataaactattcaatagaaaagcgactttctcctacataatcccaatgtaatcatgaatagattacgctatcttccaattcatttgaagtttttaaagtgtccctcagtgactttgggatgtgaactctccgagtagaagcatgtgcactgcaagtaaacttgtgcagccctggtctgagctggggcagctggagacacagcccctgggctgagttctgagctgccctgggcccttcaactgggcacagccctgccctgcccctgctcatttgcatgtccccagagcaccgcccacctctctgggcatttaggagcaggctgctcccgccccatgcaggaggcagtgccagtcaggacccagcatggacacgagggcccccactcagctgctggggctcctgctgctctggctcccaggtaaggaaggccagcagcaggaacggcctcggacagtgtggccagggctgcctgtctctgcaggagtgtcctctttgaacatgaggatgagtgtggtctctgtgtttctgtttccctcctcagg

SEQ ID NO: 151 - DNA, 15702 bp, Oryctolagus cuniculus
ccacggtgatacaagccctaacagaaaccccccaggaaagcagaagtgtgaggctgggctgccccagctgcccctcctgggccccatctgctgagagtgattctcagagcagccaggcttgaaggtcctgtagggtcaggtggaaggggccagggtgactcctcttgtaggaccccaaaagcggtgtcctcttgtgacgaccccagaaacacagacttcggaccagacgatgcaatagaacaggaggtaatttatttcatttgtacaaatgggccctctactgctgcaagcagcaagcaagcgagaggagccccgagcagctatctcacacagcttttaaagggcaaaaccacaaaattaacatattataggctggcgtaagttcattggataattttcagtagcgggccttgtatggcagtctaaaagtggtaatgtcggtggaaaagtactaggtcaaagggatacattaggggagggggtttctaggagagaggaataggttgctacgtgccttgtagctttttttagttaaccttgagcaagcgtagggaaggggcttatctacaaggcaggtgttctgtgtatctctggttagtagctgactgctttctctgtgaaccggtttactccccatttcccaaggccgtctctggaacggtttgtctcaggagccccattttttttatggtggctcttggctcctttcattcccccattttctctttgaactaattttaatcctaaaattgtgtgccgttaatgaggggtttcaatacggtcactggtggccagggcttgatactgttgcgtgaggactaatgccaatgatcagcaagccaggccttagcatgtgggcccatggccagccatgggtccccatatttttttctttttttattaaattgagaatggcctctgtcttaggttgccctcagtcatctctgtccttacccgtcatcggtaactctggcagcttggcctagagccctgtcttaggttggtacaggatgctgagcgtcttacccgtctttgagtaccattccagcccaacattaggtgagagatgaaacatacagccaaatatcaattattttgattacaaaggaggcttagtacgaagttttaaatgatgaatcttagtccattcatactatagggaagtcagcataaaatgcagaacacacggaagacatcccatacaaagtgggaaaagcagtagcagtccagccaacattaataaccaatgaatccattgaaacccttcaaatgaatagtgggttagtaataaacatatgttgcattttactcttaagtttatcaataacagactctatatatggcacattgttagtaatgttaaaataacatcccccaggtacagatttataatttatatgatttttttttaatagcaagtaattgttagctgcatggcttaaaagcactcctgagtgaacttgatccaattctttggctatattggatagcacagtagcagtaagattgattgctttggtcaccaaacatgtaagccttcatagtccacgattatttccaaaagccagtccaggaacacttactactgatgcagccatggcaagggcagtgtcctctcctattaggatgacgttgttattgtagtcttcaggtaaagcacgccactgacgtgctctatccgctgctgtaaatacagatgttagcatcagggccacaccgcccagggagcaattgcagaaaggcatgttggttacatggaaaaacccatcccttaggagcccttgtcccataccagtactggatcaggtccattccattgattggtgataggatccctccatttcaccactgctctttttacagctgtttttaagcagttaggatttaacagagacatcaagagaacataatagattactttaactcattgctttaacagaggatcagattttgattttatgtcaaagaaaataaccaaagatttcttcttcccataacattttgcgactttctcacaccttctgtaacttgctcaaacctttctcttctccccccccttttttttcattccagtataaaccagccattaagataaacaatttttacaaaccatgtccttcttttatttaaaaatatcttttccttttaactttccttatcaagaacacgcttttatgtttgtgaccttttacatcaaaatgacggtatctgggactgtagcagtcaatgggagagtaactttgtttaattccctgtaatccacagtcatttttcaggttttatttgatttcttaacatgccaaattagataattccttttagtgattatgggaatcatcactccagcactaagataatttttttactgttttagatatttcctcatatccacctggaattctgtattgtttacactgaataaccttagttggccctggcagcagtacaggagcttgatataatttttttaccactacctagcagtttgactccaaaagggcagcattttttttttccaatttacatttatcctgtacttatttttttaattgcttacacatgcatcagtatgcagataacaaaatccattctcacctccccaaagcctatagttcatcccccttttccaccagcactgatagcaaaacctcaataacttgtggaggctgtgcactctgtaacttgccatcccaattctcactcgattctgagcagagagcccattccttcaccaaagaggcgaactgaaggtcttttcagccaggaacatcacaggttacacatgcaacttcagtttttcttttaaagaaaggcattgctttgcatacttgcagatcctgccaactacgccaatttgtgacagtaaattactttttagctgtctgctgtgcacagacttagttacttttaatctgcaagaaatacgctgcaagccttgtagtgcacactaaaattatttacaggaaagatggtaaaggagcatagattaacagaatgttgcaataaacatggctccattgctttaatgatactatagcaagatggtccactgatccctgtagggagggcctgaggctggccccacttccagtttcctgaactctgttttttaatgaattaccttctttatcagttttggagtgacatttattggcccaatgtcttcccctttagcactggaagcaaatcccaggaagagccttattttgatttttgacttctggacaatttttgtacatgtccctgttgcccacatttatagcaccctcatttatcaggcatagccctccttgatgatttttgtaatgacataccaagcagagcgtcaggtcctgaatgtcctgttattaatccattttgttaatttttcattaaagggactgtcacagaacacctcaatcacagtagccaattgatcatgtaatcattacaggcatatttaacattcagcttgactgcgtgttcccccaggatgaaacagcagcaacagaggcttgctccggctcccccctaaagcctccaaggacaagggtggctcattgccaagattttaggcaagcagtgcgtcccatctcgggtcttggccagagagccgagacatgaagcatgcccacctgtttatcagaaaacattcctttatcctcctccccgggaactggccaggctcccaaggcgcaggagaaggtcattcggcagcaaagtttcttggttaccagagccaaatctaggtacaagcctctccagcccaaaaatttgtccttacatttggccctagagttgcattgagaggtagacataattaacacattataagaatacaatccacatttttcatacaagtatacatctagcaatcaaacacaacaataaaaacagatgggggagacagtaagagataaaggacaacaaaaacagtgacacacagaacacaaatcacaagccgtgcggcaacagaccgagacaaaaccgaaactatcagaagggagtggcagtctagccaggctctcccctggaagaaaggaaattccctctttccctccttcccagaccaccaccggagcgttctccagggttgaaccaggggtctcaggacacgtctgaaatcacaagccgcgcagcaacagaccgagacaaaaccaaaaccaaaatctcagaagggagcggccgtttggccaggctctccctttgaagaagggaatcactctctttccctccttcccagaccaccactggagcgtcctccagggttggaccaggggcctcacgacacgtctgtctcccctttggtccagtcagtactgagcctgtacaggcgccccaggacggattccacgtcgtcctggcagacaaggacaaacagtacaaaccacagttacaatgatacacaagtaagcaaacttacctccgtctggccgatggagtgtgggagtctggggtcccccaaatcccagacgagcccccagatgtaggaccctaaaagcggtgtcctcttgtgacgaccccagaaacacagacttcggaccagacgatgcaatagaacaggaggtaatttatttcatttgtacaaatgggccctctactgctgcaagcagcaagcaagcgagaggagccccgagcagctatctcacacagcttttaaagggcaaaaccacaaaattaacatattataggctggcgtaagttcattggataattttcagtagcgggccttgtatggcagtctaaaagtggtaatgtcggtggaaaagtactaggtcaaagggatacattaggggagggggtttctaggagagaggaataggttgctacgtgccttgtagctttttttagttaaccttgagcaagcgtagggaaggggcttatctacaaggcaggtgttctgtgtatctctggttagtagctgactgctttctctgtgaaccggtttattccccatttcccaaggccgtctctggaacagtttgtctcaggagccccattttttttatggtggctcttggctcctttcactctgaggctccttccttcctcctccttggtggcagtagcacagacatgaccatgtccctactgttttaaaggaaaacaattattctttctgagtatttgaaactagtgcattatttgagattcatagagcaaatgagaaaacattatagatattacaaggaaagatatattaaatactgtaaattagaaaaatttataaaggataccaatttcatatctacagtttttttatatgtacagttttttaaaaaagttttgtttgcttatttaaacatgctttacactcacacagagacatacacacacagtgacagagagagaattcacttctatctgctgattcactcctccaatggctgcactggctgaggctgtgcctggcaagagctggggcatggaacttctttcacatctcccacatgggtgtcagggctgaaacacttgttccatgcactggtgctttcccaggccagtagcagggagctcgtttggaattggagcagccaggactccaccggtgcccctgtgggatgctggcgctgcatagggcggctttacccactgcacaaggctggcccaccctatccagagttgtgagagcataatggcacttcccaccatgtcctcccattctcaaaccaccccaacttctcttctgttttgtttaaattttacactgacatactttcactctataatcaccagcttaactctccactaaacaaaattcaacacggagtagcagaaaaaacacaattcctcaagagtctagtcaaggtatgagtctcttcctcccagtccctctgtcactaccagacctgaggtgcactggcgccctctgtggtgagaggtggaatcccgtctgctttgaatccctgcttgagcagttcttcattcaattcaaaatcaaatagcaaattctcattgaattgaaccaatagtagcttcattgtacacagtggctcacagtgaacagtatcacaatctcctaggcatagaagaattgtaaaattgaacagagcccttcatcccatagatctttcattttagtgagcagggcaggtaataacatacaacggtctacaactgctcccactctggtccatgtgagaggcctccccgaagcactgctatatattggggcaggtgggcagtgtgtgtccaggtccacttagtgcatcctcctgtgttggggcagaagcagagggaacgcatcaggcagttcaacttttgtgcttcctgaaaaagttaattaattgtagtctcagtaacgtcagattgaaacgttgtcctttggttgaggaagaagctttttaaatttctcaaattgctgaggcatgaaaccagtgaacacacaggtcagtggaaaaatcagtgcccttggctggcactgtggctcacttggctaattctccacctgtggctccggcaccctgggttctagtcccggttggggcgtgggtattagtcccggttgcttctcttccagtccagctctctactgtggcctgggagggcagagaaggatggcccaagtgcctgggttcctgcacttgcatgggagactgggaggaagtacccagctcctggcttgggatcggcgcaactccagcctaatggcagccattaggggagtgaatcagtggaaggaagacctttctttctgtctctttctctcacagtgtcttactctgcctggcaaaaaaaaaaaaaaaaaaaaaaaaaaaaaaaaaaaaaaaaaaaaaaaatcagtgcccagacactggatatataaagaggaacccaatttagtaagggtgtcttgtactgttgttaatatttatttcttgtgaagataattttctgaaatgttcaccctttccatttttcaaaacatttttttatttacttgaaagagtgagcattgatgagctgcaaaatgtgagtgactgagtgggaggaaggcagagacagagagagatggagagagaaagtgaatcttccatacactcgtctttccccagatgacccttacagctggggctggaccaggccaagatcagggccgagaactctgcgttgggctcccagtgtgtggcacggatcaatgtacagccgtttccctcgaagtgtgttatatctattgctcttttacatcacaccaaggccattagggaaatagagaaagcagaagctgccctgccgcagtgacgtccagcagaaccacactgaaagtcagaggtacacatgttaccacagaagcaaagggtccttgtcttcgcacaagaaagaattcaggcatgagacagagagtagtggaaagcaaaatagcaaggtttattagggtagggacatccgtaagaacggatgggctcctctccagacaggacctgagagagagtgcatatggcacatttaggctggggtttttaagggaatggatcttgccatccctccccctctccttctccttctgggacaaaggacctgttagatgtaaatacaaaaaattcctttctgagtttttccccctgaagttatcagacaggggaagcctggctggcctagccccaccttagaggaaagatgtttatcaggccagggagatggggcaggaccttgtggaaggtcatcaggatcctggcaggacttttgaaaagcagatactgggctgcacctggaaggttattgggatgatttgaaatgcgggccggagcactgaaaatgtcaattctttaggtctttgtcacacacacacaagctcatttctgacttcctacctaatattcccccctcaagagagagatacccataattctttttgggataaatggattgagttccgttttctgtagctacttccaagatgacatacgggcatagagatggatataggtatttcctcttgctctctgtcctatggtatgtgacagtagccttggaaagactgtcctgctctgtccagagggctgctcaggttgtccaaatgcatgggctggaagccttgtctgatgaacatttcaagttcgacagcttttattccgttagagacaaaatgaacgaaggcattaaaaatgcacagtccaaagagaagcagcaagattacagaagttacagggccaaggataggcaatagccaggatttccatgaccagatgtcaggccagaaatcccagcccttcttagcctggtcctggagctgtttggctttgtccaggaaagtacgaagttgggtttgtacctgtccagtctgattgacccagaaacaaccttcttcccggagcatggcacagacaccttcctgagccacagttagcatgcccagtgcttgtctgttttggagaacaacagcagccaaagagttgatctgtttggaggatgaagagagaagctgctatttgggtgttaagaccagccagtttggaggagaggctagtagacatattgtttgctgatactgcccctgttgtgcctgtagcaactcgtgtcactccagccaccatgctgatccctaccaggacagggattagaggggaaatcctcttggagagttgagaagtagtgtgtaagggaatcggtgtaggggctgaagcattagcaacagatatagtagacaggacataggccatggtacagagccctgtccagttagaaggtaagcattggtaagcaagagtcccacagacaaagtatatcccccctgtgggagggaggcatccagagaggtggtgtatactaagttgggaattttcagtagtggtgcgtttgaagaagtaggtggcaacaaaggaagcttcagttagtagactaaaatgtggggtgttgttgtgggaagtactgctcatctgatcttcccagaacattacccatctagaggtgtcgatgaaagtccgggccaacttgccatcctcatgaatgagggagcaattatctattcctatgttgccccaatgagaatcggccattaaagctgaggcacaagggggcttttgcccttagtgtgaccttagtatagataggtcctataacaggatatgagaggtcgtcttttttaattgatgtgtgaacaccctgacacccagtagaagttgagtagtacatatatccttctgtctgagcccattcccttagagaggctggccatgcttccccagatgagccccgtgtctccaggcaaatccagcaggagtggccataggaagtgttggccaataaagtgcagcctgcagtggcctaataaagggtgaggcatcagttaggagtacgggtgggaagcatgccagtagaaagaaaaaaggaaggcgtgggcacggcatctttatttatctgggctccttttaaagagtaggcgcaaatcttccagaggctccattgaccaggtatctttaggttcaggatcctgctggtcttcagggcagtatggctttaccaccactttcccctggaactggcattaaggtagctggattcaaagtggagcaatgcattatttttacctgagagttttctagaaggaggacctgatattttagtattctactatctgtgagccaatgagagtccttttgctctaatagagaatttatttgatgtgaggtataaagggcaatattttgtcttcatgtaattttagaagcctcctctgtcagcaaggcagctgctgctattatccttaggaagtgaggccatccttatgcaaccatgtctaaggtttcataaaagtagctcacaggtcacttaacaggtcccagatcctgagataacactcctaagacaacttcctgcctctcagtgacatacagctggtagggtttctctgggtttggcagtcctagcacaggggctttagtcatagcatcctttagctgagcaaagtctgtaatttgctctttctccctgaggagggggccttgttctgggctgtcttttaggggctggtatagaggccttgctacttctccatattttggaatccataacctacaatacccagtcagtctgaggaatgctcagagttgccttaaagtggtagaggtggggatttgctgtatggcctgtattctctctggggctagtctcctctccccaggagtgaggatgagccctaaatagttaacttcctggcgaaccagctgtgccttcttcttggatactcggtagccacgttctgccaggaagttaagggttttgattaaatgctgaaggccagagtctcgagtggggaacagataagcaagtcgtctatgtactggagtattctcccacccccctcaagagataggtccttgaggtcctctggaagggcctgcccaactaggtgtggtgcatcccagaagccctgtagtaatacagtccaggttagctgttgctttaagttctgtctattgacccattcgaaggaaaataaaaactgacaggaggggtctataggaatacagaaaaaagcctccttaaggtctgagactgaaaaccatttagtccctggaggtacagggattgggcacaatagggtgaatgggtattactgcctcattaatgacccctaagtcttgaactaatctgtattctccatgtttctttttaacttgcagattggcacattgctttttttttttttttttttttacaggcagagttagacagtgagagagagagagagacagagagaaaagtcttccttccattggttcatcctccaaatggctctacacccggtgctctgcaccgatctgaagccaggagccatgtgcttccttctggtctcccatacaggtgcaaggcccaagcacttgggccatcctgcactgcctttccaggccacagcagagagctggactggaagaggagcaaccaggacagaatccagtgccccaactgtgactataacctggggtactggcccaacaggtggaggattagccaagtgaaccacggcactggcccagattggcatattgcaaggggaattgcagggtgttaacaacccatgctttaggaacttgtccatttagtggctgtagaccttctctagcttctggctttgtaggatattgtttccaatttgggaaattattaggatccttaagttaataatgattgggcgggccttcaaggcccagcaaggaatgtctgaggcccaagcctgtgggttaacttgtagctctatctctttacatggtatgtcaggagacaggtgaggcatatggcagtagtaggagtttggccatcatcatgtgcagagaaagtcactcgagtccccaacttacttagaagttcccttcccaataggggtgtgggacactcagccattactaggaactgatgggaaaatatggccttcccccaaaggcaacataaagggggtgtgcacctccttagggaggggaccctgtgaccctgttgacttccattacttggctggactgtgaggagtgttggccagaataggaaacgagtacagaataggcagctcccgtgtctaagacaaaatttacggtcctacctgccacatcaactgcgactctaggctctgccccctcgatggtgatggttgctttgggaacctgacagagcaaagggctccttcagtttagggccaataggttttgcactcttgaaccaggggtcctttgactctcgggacagtctcgcttccagtggccaggctttttgcagagtggacagggctcctttggaagccggctgctgctacgacagcctcttgcccagtgccctggcttcctgcagcaaaagcagttaccacttggaggtgggctggccttgctgggtccctttgatggtaattatcatgtaaagcagctatcaactgggcctgctgcctatccttacactcttccttttgtttgtctcatcctcctcctcctggtctctgttaaaataaatggtagaagcagccttgataatgtcagccaagggggtgcttggtcccatccctaatttctgaagctttcttctaatatcaggggtggcttgagttaggaatctgtcccctagtatagcatttcctacagcagagtcaggatctaaatcagtatacttatcaagaccctctttgacctttctagaaaggcagctggattttcctgcggcccctgttctatcattgatagtttattaaagttctttggtcttgccttactggctgcccttagacctgctagaagatatccagcatgtggtctctacctttctgtccctcaggagtgctatagttccatgaagtttccttaattaagatcgctacctccgccactgggtgtccctcatcttgcctatgcaaggcgtttgcataatcactgacatgctgcgacaccatctgcttttgcccatgagttaggatagtgtttagaaggaatgctatgtccttccatgtaagctcaaacataccagttataccatccctctcaccacctgttggggtcctcagtgaagcttcccatttctgttttcatctcatttaaatcctgcattttaaaggggacctgtatttttgtggggctattgggtcctaccacttcctgtaggggaaacattcctgcatcctccatgctcatgcccaagctcacactcacgcttgggcttgggggttgacactctgagcaaggaagggctgttggctttacaggaggctgagggcgtgctggcttccaggcatctgtgggagcgctatcttgtggtggcagctcttttggcttagctttacagtgcactcctgatagtagatcaaatgaagttagcattgctgagtccagtttgcaactttgacagagctcatgatttttcctgagtgccaaaagacctgtacataagggatttctgtccatttaccctgctcacggcagtatagatatcaatgagaagtggtattagaatctaaagtcccacttcctggccacactctctgatcacctggtttatattgtgaccaaacgttgttacagagggaaactagcaattccttctttaagaccctgggattgaactgagatcagtttctgagaatgcatcctagtggtgagtcacgtggtggtaaggagagctggtttcccaattgaaagaaaataggggtgagaccttaatccactcaacttgaatatttcaaccaaagccagatccattcaaggctactgcaatcacccagtcaattaaaaacagttaactttagctccttcttagattcagttctcaggcaatcaaagcttagcaacaacaagagaaaatgcacaaaaaaacttttcaaggcacatgaaaactgccataagctgcaaagatggaaaacctatttgccaggttggagcaagttatctatcagatcaaggttttttccttccttgggtggagagacctgtggaatttccctctcccctcctggtggccagcagcatagcaatggagatgaggagaaacaaagagaggggaggagacagagagggaggaggaagggggaaaagtgacagaggaaaagatgtgatccagtgccctcaacttcatcagaaatctcagctgtgcctgtgaggcatctcaacgggaggagagcatagcgaaaggccctgatgtctgggggctagtgggtgttcagaatctcctatcgctcatgattgcccactacctagctgtctgagtttacctggagggccaatattagcctccatggaagctaagccctgctcatgtagcagtaggcagcatgaccaagcatccctccaagagagaggccaagtcctcgggtcgcagtccggctaccaggaagccaaagcaagctcagggggtctcctggctctctgccaactgcccttcctagttgccctcccattccttacaatctctctgcagtttcagctgtagctaagccgttaccaggggcactccatgttctcagagagctgtggggttccggatgatcaatggtcactcccacagatccagtcccactagagggaagggatgtctttttttctttctttttttgacagtcagagcggacagtgtgtgagagagagagagagagaaaggtcttcctttaccattggttcagcctccaatggccgctgcggccagtgcactgcggccagcgcactgcgctgagccgaagccaggagccaggtgcttgtcctggtctcccatatgggtgcagggcccaagcacttgggccatcctctactgcactcctgggccacagcagagagctggcctggaagaggggcaaccgggacagaatctggtgccccggctgggactagaacccagtgtgccggcgccgcagatggaggattgagccacggcgccggactcaatgttttcttaaaatcccctcctggtcaccagaaatgttgccggagaaacaaaggatcctcgttttcacgccagaaagaattcaggcatgagacagagagtagtggaatgcaaaatagcaaggtttattagagtagggacatccctaaggatggatgggcacctctccagacaggacctgagagagagtgtggtagttcacatttaggctagggtttttaaggagatgggtcttgccttccctctccttctcctcccgggactagggacttgttggatataaatacaaaaaattcctttctgagttttccccctgaagttatcagacaggggaagcctggctggtgtcaccccgccttagaggaaggatggttatcaggtagaatgggcaggaccctggaaggtcacaggattcgggcaggatgtttgaagtgcaggtactgggctgcacctggaaggtgatcgggtagaaggggcaggaccctggaaggtcatcaggatcgggcaggactttgaaaggcagatacagggctgcacctgaaggttatcaggatgactttgagatgcggatgctggacctatatgtcacttccttaggcctttgtcacacactcataagctcatttctgacttcctacctaacactttctcatctcaagcacctgcgttctccttctgagtcctggtctctctctggcagccgcttggtctgaggatgtttattctgagtcagtacagaggtgagtgtggacagaagtctcgtctctcagagaccatctccctggtgcagcggtctgccgtgaggggacaacgtgagggcatcaggatacacaagaaaagacatggccctaggtgttaactattctctagaaaagtgactttctcctacagaatcccaacataaccatgaataaatgacaacaacttgtcctccagctcagttaaagtgttggtaaaagtccttcagagattttgggatgtcaaatcttatggtagaaacatggggtctgcagggaaacttgtgtagccctggtctgagctggggcatctggagacacagcccctggcctgagttctgagctgccctgggcccttcagctgggcacagccctgccccgcccctgctcatttgcatgtccccagagcaccgcccacctctctgggcatttaggcccaggctgctcccgccccatgcaggaggcagtgccaggcaggacccagcatggacacaagggcccccactcagctgctggggctcctgctgctctggctcccaggtaaggaaggccagcagcaggaacggcctcgggcagtgtgtccagggctgcccatctctgcaggagcgtcctcttagaacgtgaggatgagtgtggtctctgtgtttctctttcccttctcagg

SEQ ID NO: 152 - DNA, 6105 bp, Oryctolagus cuniculus
ttgctgatctatgctctgccggcacttcattgtttctccagactgcatatgcctcacaatatcaaatctcctaggcatagaatatttgtaaaaagctgagcagagctcttcatctcataaatctctcattttgtggacagggcagatatgcgtggctcactaggctaatcctcctcctggccccggcacaccgggttttagtcccggtccgggcgccggattctgtcccggttgcccctcttccaggccagttctctgctgtggccaggcagtgcagttggggatggcccaagtgcttgggccctgcacccacatgggagaccaggagaagcacctggctcctggcttcagcgcgccggtcgtagtggccttttgttggttgaaccaatggaaggaagacctttctctctgtttctctctctctgtctctctgactgtccaaatctgcctgtcaaaaaaaaaaaaaaaaaaaaaaaagaaagaaagaaagaaaaagaaagaaacatataatgtttctacaccggctcccactctgccccacatgagattcctccccaggggcactgccattgcttgggcaagtgggcagtgggtgtccaggtccttacagttcattctcctctctcggggacagaggcagaggcagaggcagaggcagaggcagatgcagagggatcttaccgtgcagttcaacatttgcgcttcatgaaaaaataaactaactaacagtaatggtcagatggccaggttgtcattggattgaggaaaaaggttttaaatttctgaaatcgctgaggaatgaaaccagccaacacacaggtcagtggaagaatcagtgcccagggggcccgagctatggcctatcaggtacgctacacctgcagtgccagcatcatctatggggctggttcaagtcctggctgctccctcagatccagctctgtgctgtggactgggaagcagtagaagatggcccaagtccttgggcccctgcacctgcataggagatctggagaaagctcttggctcctgattccttgctcctggcttcagattggcacagctctgcccattgcagccaattggggactgaacaaatggatggaagacctttctctctctctctccctctctgcctctctgcctctccgcctctccttctctctgtgtgtaactctgcctttcaagaaatatgtatttatttatttacttgaaagacagcattggtggaaaacaaagtgagagagactgagagggagatgagagagagagagagagagagagagagagtgagtttctgttcattggtttactcccccaaaggccaggctgaagccagtagcccaggactccacccaggcctcccatgtagatggcagggacccaggcacctgagtcctcactctcagggagcacatgagcaggaagctggcatcaggagcagactgggattagaccaggcactcagtgtgggatgtgagcaacccaagggccaggccgatgccgggggtcagggactccatctgggcctatgtggggggcagtagcctcctgaccacaaaagagcccagggccctgttaacgacttcctcaacctgtgtgcatgctcagaatagcgcaatgtgaccaacatgtgaccttcctggggtcagcaacaccaccacttggagcatgtcatgggcaagatagctaacagctcccacacagcgcagagctgggtgcacactgaactgttgtgggtcaagggcgacgagccgcaaccacaggctgggtgcagatctcggtgtcgtgtgcctagaaaaactgctctgtcttcccaagtccatagaagcaggggcttagctcccgttgggggaccagtcggagggactcctgcctgctgtgctccctccctgagctcctgcacaagaccacaggaaacctggtctgcactgcaggtcaccctcttggtaatttctatttgcaagtgagtccaggaacctgggctggcaacaaaaccttatcacccatggcccctccttagaaactccaaaatattctaataagagaaaggagtgcagagaatccctgaagtgcaggcgtctccagtaggaatcaggttatgaggccggcatccggacctgcacaatttgcccttcactcattcctggtgcctcacatgctctgcccacacccccaggcacagccctcagactcagggacttttaactcaaccctgtagagatctagggctcagcaccattgggcagtgcaggagcggccagggaatgtcactggtcctggtgcttgggcatccattgttctgtgtgccaggtgaggcgaatgagccaaatttcagaaatagaatgaatggttcttccagtgtgtctgtgtctcgtgcttttgagatgtgacacaggataagcgtcccagcattgctgatttctgcagttctggcattgaggaggtgagttattgctcttgttttttctttctttctttttttttttttaataaaccaacttcctcaccctacaggttcagtctgtctgtgagtgcaggtccgaggagcacattgatcttgcttgaactttaccattacagattgtgttcccagaggaagtcaacaacagctccctgctggtcggatgcaaaacccctactgtggtatcagcacctgcctggactgtctccttgctcttggtcacagcatttgacagagtccataggctgcctatctctttaggagcctggaatattcactgagaaacacactggaacctagaaaaatctgaatcctttagttctaagaagaggaacagagtgccaagctgtggcaggccattctcaggatcaagcaagaggagatggacttgatgtgggaatttataaacaagtcatttttgtaggaaatcatcatgtttatctagtggagaaggagacagtgagggtcaggctatactcccaaacttgtcttttttctggtttgcatctggttcttgattcaagttggctgagagacagatattaccctctgcagggtagaagctgaaaatgctgtaggctttgctgtccctcccaggggactggggctaaggcagaaacctcccaggggaggcctttcaggcaagttcaactgccagggctgcttctccttccctggagctcccacgttactctaaacacacacgtgtctgtgtgcccagcttgtctatgtgactactgggtcggagacagagaccttggagctctttctatattaccacctccttgtttctgtcctgaacacatttgatgtttccttcgcttctcctgcagctacaaacaaaaactcccgtattgatcttttctctccagccctgacttccacacgatctctcactcggactcttgaaatttttgtgattttttttcaagggtcataaacatcaatttatacaaccctagtgattgtcccaagtttatttatttttaattttttttatttttgacaggcagagtggacagtgagagagacagagagaaaggtcttcctttactgttggttcaccttccaatggccactgtagccggcgcaccacgctgatccgaagccagcagccacgtgcttctttctggtctcccatgtgggtgcaggacccaagcacttgggccatcctgcactgtactccctggccacagcagagagctggcctggaagaggggcaaccgggacagaatccggcaccccgactaggactagaacccagtgtgccagtgccgtaggcggaggattagcctagtgagccatggtgtcggcctgtcccaaagtttagaaagaggaatattggccatgaaagagccccatgtagcagtgagattttctttccgtagtggcaaaggggggcagagtgactgcaccacagcttatctttctcacgtattacagctgagatggctgcagtatggaatacaggaaggaaatgcaggagatgttccccgtctcgcagcccacagaaccagagctcaggtgtcagctgggccgcactcgcttccggaagatgccctggggaagctgccgggtgtgagccccctcgggtggcagcagaaccgacggtcttgtgctgattcgggtggaaatgtcaggtgcgcgccgatgttgggacagactccagcatggccgggtgccttttcaaggcccgtgcaggtggaagaagggatcttccagcaagacgaggtggaaatgcgtcagctttcaattcctgatagagcagttcttcatggaatccaaaaccagtaaaaattctcatcgaattgcacaaatagcagcctccttgtttgtatccatctgcacaaaaataacagtagcacaactttaggcatagaagaattggggcaagtcaggcagggcagataataaaccaatgacgttctacctctgctccctctcggctccatggtagaggcctcccctgggcagcacgattgctcaggacaaggggcctgtgggtgtccaggtgcatttgtgcatcctcagtctcagcctagacagggactgaggcagagaaacgtgtcagtcagttctacgcttgtgtttccaggaaaaagctaaggtgtggtctcagtaatggtcacagagccaaagcatcctatgattgctgaaaaagtttttaaatgttcacattcctgtagcatgaaaccaggcaacactgaggtcagtggcaagaatcagtgtcctgacactggagataaccacaaatggagcccagttttaagagggtgtgtttctagtgatgttaactttcttccatggtaccattttctatttttcaaaatatttatttacctgaaacctgacaattggagagaggcaaagacagagagtgattgagaggaagagagaagacagagagagagagagagagagcaagacagagagcgagagagatagagagagatatattccataacctggtttactctacaaatggctgtaacagtgagttcttggccaagcagaagcccagagccagaactgtccccgggtctcccctgtggggcaggaatccaagaacttgggccattttctgttgcctcccagggtgcgcattagcaggaaatgggatcagaagtggagcagtgggattcaaaccagtctccggtatatgctgctggcatgcaagtggcaggcatatccactgtgccacgatgctggagttccctcctttccggatgttaagaaaaacctgaaagtttcaggacagaggggagagggaagttctttcctttatgtcctcagacctatggtgacctcttgaaactttcacccgttgtttcttcttgtgtcctgactcagaactcaggctgcagatgggagagtgcacatgtgtgatctctcatctaagcacctgcgttctccttctgagtcctggtctctggcagccgcttgttctgagaatgtttattctgagtcagtacagaggtgagtgtggacagaagtctcgtctctcagagaccatctccctggtgcagcggtctccgtgaactttcaatgtgagggcatcagaacactcaagaaaagacatggccctaggctagaaggtgttaactattctctagaaaagtgacgttctcctccagaatccccacataaccatgaatgcatgacaacaactgtctgccagttcgcttaaagtgttggaaatttccctcagtgactctgggaggtgacatcacccggtagaagcatgcgcacctcaggtaaccttgtgcagccctggtctgagctggggcagctggagacacagcccctgggctgagttctgagctgccctgggcccttcagctgggcacagccctgccctgcccctgctcatttgcatgtccccagagcaccgcccacctctctgggcatttaggagcaggctgctcccgccccatgcaggaggcagtgccaggcaggacccagcatggacacgagggcccccctcagctgctggggctcctgctgctctggctcccaggtaaggaaggccagcagcaggaacggcctcgggcagtgtgtccagggctgcccgtctctgcaggagcgtcctcttagaacatgaggatgagtgtggtctctgtgtttctgtttccctcctcagg

SEQ ID NO: 153 - DNA, 161 bp, Oryctolagus cuniculus
ccacagtgttacaagccctaataaaaaccacccaggaaagcaacagcaccgacatgaccatgtccctgctgttctaaaggaaatgaattattctgtctgagtattcaaagcttgcatgcctgcaggtcgactctagaggatccccgggtaccgagctcgaa

SEQ ID NO: 154 - DNA, 443 bp, Gallus domesticus
agaggatcctattaattgtttgttaattaagaggacaggaattcagtgtcagggggctgctctttgcttcccaatgtgtaccactgaagcctctctggatttatcagagatactcaatggactcttaacagcactgtggcacctgacctcctgctgccttcagcctcccttcctggctggtgtgcttgtgttgaggagctgtgggaggctggtgcagttctgtgggatgaggtaaggccagctgaatagcctgggggctggtcagggggcttagtgagaggagcagggctggggaatattgtgaacagcaggtggtgccactgctattctgaggaaggaggcagcttctgcaaatgctttgcaatgcaggatgacaaagtgcttctgctagctctaggcccttgctcatggctgtgatggtgcttaacggtgccagagtgcag

SEQ ID NO: 155 - DNA, 718 bp, Gallus domesticus
ctatggctggtaccagcagaagacacctggcagtgcccctctcactgtgatctatcaaaacacaaagagaccttcaggtatatctttatacttcagctggtaccagcagaagacctctggcagtgcatctgtcgctgtgctgaaaccaacagacacaccaacaccacaggacagcttcttgcagttctccatctcctggtgcagcttcatgagcacgttaaccatcgtggggattcaagctgaggatgtagctgtctatccctgtggcaacagggacagcagtggtaagcctggtgaggtgatacagggagatgtcaaaaaaaaagaaaaacccaacatgtatggggttaaaaatggaggctctctgcccttttctctcatggctgagctgggctgtgcagtgaggtaagttcctgtctcgtctgcaaagcactgtctgaatggtctccctattgtgtgttgtggtgcatgagggattctggggacagagggcatttgtctgtccctataaaggcccaaagcccctggctgtgtacagtaagtccgcctggggcacctgagctgtgggcaggtactgccaggagaggggctcaggccatgatccaataccaatggctctgtgtccccatgctaatagggctatgctgcagcccatcactccctcttaaaccccctcttaaacttcctacagttctaagttctatctctctcctccaat

SEQ ID NO: 156 - DNA, 108 bp, Gallus domesticus
gtgcgacacacacagccctcagcgtactgcggtgggataatacttctgagcacacagtcccaaatggaacctcaggactctctcatctgcttcaggatgaacaatgtc

SEQ ID NO: 157 - DNA, 425 bp, Gallus domesticus
aggcagcagtaatcctggtttggtgatacagggagatgtgcctccccccaaaaaaaccccaaacaaacaaaaagcatatatagggggtaaaaatggagtttttctgcccatctgtctcacagccaagctgggctgtgcagctgcggcaggttcctggcctctctgcaaagctctgtttgtgaatggccttccttcctcttgtaccttgtggtgcaggaggagattgtggggacagaagccacttctccttgtccctacaaaggcacagcactgtgtcatccccagccctcctccatgttactgctggcagtcccgtcctcctgcttctgaagagacatggatgtaggtgaggtctcttctgcaacagtggtgttcatcaccccacagctgccaggtgagggctgtgtgtgtcggacatttggctg

SEQ ID NO: 158 - DNA, 92 bp, Gallus domesticus
gaactgggagaggagaggggggagaaaatggagttcattgagtccctgatatacggagtccttgctaggcaatgagataagacagctgagcc

SEQ ID NO: 159 - DNA, 547 bp, Gallus domesticus
cagcttctcacaatcctacacgttctggtgcagcttcatgagcacattagccattgtggggactcaagctgaggatgtggctgtctatttctgtggcagcagggacagcagaggtaagcctggtgaggtgatacagggagatgtcaaaaaaaaatgaaacaacatgtataggagttaaaaatggaggttttctgctctcttctctcacaggtgagctgggctgtgcagtgagatgagttcctgtcccctctgcaaagcactgtctgaatggtctccctgctgtgtgttgtggtgcatgaggagagtctgaagacagagggtacttctccctgtccctgagaagctgctgcatggtgtcatccccagccctgctgcatgttacactgtctgccctgtccttctgatgccgaagctgcttccatgctgggatgctctgggctgagctctgattctccaaaatggcagtggtttcttctgatggtggtggtattcctcattctactgctgtgcagggagggctgtgtgtgtgttggctacccactgagcc

SEQ ID NO: 160 - DNA, 196 bp, Gallus domesticus
cagtgaggggcattgaggctgggaacaatgcagtgctgtgcctttgcaggaacagggataacggggcactggacccagaattgattactgaatgaaaaggttcagtaagagaggacatgcgtgtgatgtacagtctggcagaagggactggattctccctcagccctgactcaacaagggcagaaagccttggttt

SEQ ID NO: 161 - DNA, 257 bp, Gallus domesticus
actttgggacctgagccagactgtacctgtccctacaaaggtacagcactatgtcatccccagccttgcttcatgttgctgctgcaagccctgttctcctgctggagctgtctctgtgctgggatgctctggtctggactctcatcttctaatgtgccggtggccatgactgaggtttcttctcctttaatagtggtgctccctttcccactgttgtacgcagagggctgtccatgtggggtattccctgagcccca

SEQ ID NO: 162 - DNA, 417 bp, Gallus domesticus
tgaggcggtgaattgatggccagagctgaaaatgatgggtttccacccttctccattatgacttttgttgagatctcttctcatgatggtcttccctggttttcctgtggttggaaggagcagaaggcactggcaggggtcttgctgggagagctggcaatagcagggatagtggatgccccacatggaagaaagggacacagctatggccacttctgatgagaggtgtccagagcacagcagcacatccctgtgcttcagacatctcctgtgccctggggtgtggaagggaatgcattcatagcatggccaggtggaggtaagagtaacatgcctactgcagtaattctgcacatagagaaggaagaaagacagaaaatcttcctacagttctaagtttcctctctcttctccaat

SEQ ID NO: 163 - DNA, 60 bp, Gallus domesticus
gtgtgacacacagccttcagcatgctgcagtgggactgagcaccagcacttgctcagctc

SEQ ID NO: 164 - DNA, 94 bp, Gallus domesticus
ccacagtgacacagagcaatggagatgtgatacacaaacctgtcagtgcagggaacagttggcactggcactcatctactcctggactcacaac

SEQ ID NO: 165 - DNA, 1010 bp, Gallus domesticus
cactgatgctggtagtgacggggagatgtgaaactgaggtacagccctgaattaaaaacgtctgttttctgcctttctcccttatgtttgttctgggctgtgtcactgaggcagttttccctctgcatggccatggctttgatcatcttttctgtcctgcctcagtgtttggaaggtgactctcccagttaccgcggaggaaccatgaagatcatttgctcctggtgtagcagtagctatggttgtggctgcatctggcttcaacagcaagttaaccattactcatgttgaaaccaaggatgaggctgtctaagatgtgtgagctagcatagcagtgaggctggtagagtgacaaagggaagcatagctgtgatgtctacttctggagtgcactggggcatgaaagcgaaaacagtcaaagccacaaccacacggagggaacaggaacatgtctacagccataactctgcgtggccaaaatgctgaaagtcagaaaaccagcagggagcggggctgggtgcagtgcatgccaaccctttgtggggacagctgtagaacatggaattcaatctcagtggagtcgaaccaattggcaggctgtcagcagaggcattccccagtgctcccctttgtttaatgtgaaattacaaacaacgctgccaggcaacaaactgtattgatctgcttgagggtaggaaggccttgtagacagatgaggataggcaaaaatcaatgggctgtgtcaaacccattgacgttcaagaacgttaagtcccagggcctgcacttaggtcataacaacacaaggcagcagtgtaggctgaagagatggttgattagagggttctgttagaatggttcaattctgtgatcatgaagataacttccaaacaaaattggtgtaggatagggataaggtgctctggccccagaatcacctgcaacaaaaaatacagcagggagggcataaacaattgcggccctgcagaggggcagggcatctgcctcag

SEQ ID NO: 166 - DNA, 228 bp, Gallus domesticus
agtaagtgcctgacacgcaacacccagtgccagaagatagcactgatccccaagacaaggagaccatgcatgccaaagaggttcctctttctctcccacttcctctcagtccggctctagggtctcccctccttcctcctgctctccttcaccctgtacatcagatcccagggctttgctgcatttctgctcctgcaggcattgcctggggccctgtggcaagaccag

SEQ ID NO: 167 - DNA, 1 bp, Gallus domesticus
c

SEQ ID NO: 168 - DNA, 771 bp, Gallus domesticus
gctgcctgacatacacagcttccccccgcaaagcagcaggacagaggccccatgcccatacaggcccaggtcacctgaactgttggtgaccatcactagtaggagaggggcccagaccatggtgctactccaacagttgtgctatggaccccaactcccttttagacccccacccttctacagcacagccacctcctgcaagcctggtgtccatggatactggccacccccatcccatgctccccttgcctcctgtagccattttccttgatctcagaagaccaatcatggttagccattactgggatccaaaatgagcacaagactatctactactgcggtagcttgggaaacagcactgatactggtagaatggcacagggagatgggaaactgagttacaaacctgagttcaaaatggaagctttctgcacttactgcattatggctggacagggctgcaggggctgagtcctgtttctgtcctctctgcacggccctgactgtaaatggcctcctctctcttcttaaccacaatgtacctgtccctgcccaggcacagcactacgtcaaccctagccctgctccatgttgctgctgtgagctcctatctccttctagagctgcctttgtgctgagatgctctgtgctgggctcttgcccacaaacatacctatgtctgtgactgaggacccttctcctctgatggtagtgcttcccctgcggttggggagggcagggcaaattgggcacctgttgagccccatttac

SEQ ID NO: 169 - DNA, 311 bp, Gallus domesticus
aaaaaaaaaaaaaaaaagacacatataggggataaaaatggaggttttctgcccatctgtctcacagccaagctgggctgtgcagctgaggcaggttcctggcccctctgcaaagcactcgttgtgaatggtctccctcttgtacagtgcagtgcaggaagagataccaggtatgtccagacctgtttgctgttactgctggcagacctatcctcctgctttgaagaggcatggatgtctgtgaggcctcatctgccagggtggtgttcctcatcccacccctgccaggtgagggctgtgcgtgtcaggca

SEQ ID NO: 170 - DNA, 271 bp, Gallus domesticus
tgcaaggagcagataatacccttaactgtctgtcttacaggttccacctccatcaataccccatgctgcagggctcaggtcctcttaggctgccaggctgcaccctgctggctccctccccactaccctacacccaccctttgcagtgtcccctgcatgcactggggcaacacttcctcacctgtccgctccctgctggagggccacagccacctggttgatacatcagcatagcaccagttcttccccaagctggccctcccttggactc

SEQ ID NO: 171 - DNA, 582 bp, Gallus domesticus
tgcaaggagcagccggcaggttttgctgtctctgtttgatggtggcacaggacctcaccacagccctaccttcactgtcctgcaatatgggtggctgtgcacggtgtcctgaacacgtcccaacaagatgcacagcactgcatcaggcccagcccctgcctgtagcagctgatgcccttgtccagcttctgcctgagctgcctctgtgctgggatgctccatgctgagctctgatcctccaaagtgcccatagctgtggctgggatcccttctgctctgatggtggtggcacattgcaggaacagagcccagaccagaacagctcagtacagagccagctccagcagggagagaatggggctgccagcagcaatgtggaacagctggggatggcacagagctgtgccttttcagggacaggtacagtgtgactcagtacccagagtaacctctcatacaactacatataccaaggaaggcatttacaagcatggccatgcagagaagatataaatcatcctcagtctcacagacctgctcagccataaggcatcaagggtgaaaaacctctattttttttta

SEQ ID NO: 172 - DNA, 532 bp, Gallus domesticus
cagggctctgtgtgtgtctgacacgcacagcctccttgtttggcagtggggtgaggctgctgagcacacagacacacatgggacagcaggagacccacatctgctccaggattgacatctatggctggtaccagcagaagatacctggcaatgccccatcactgggatccatgctaacactggtagacccacaggcgttctcttaccattctctggggtccaatccaggcctacacacatgaactgtcacactaactaccactgtggtctaagctgtggagaacactgcccattactgcggtggcaatgacaggagccaaggcctgaggatggcacttatcaccaggatagcaggacaaggggttcacaagaaaaaaagaaaggttcttttttcctctcccgcttcctctcagtccagctctgtggtctcttctccttcctactgctctccttcaccctgtacatcagatcccagggcttcgctgcatttctgctcctgcaggcattgcctggggccctgtggcaagaccag

SEQ ID NO: 173 - DNA, 188 bp, Gallus domesticus
taaacacagccacattcacagtaaagttttcaggccaccttccttggtccccgagctttgggaattgtgacttatgttactgttttgggaattcaggaggccttgtcctatctgaatggccaagaccttgactgttaccccagatcatattccaggaatgagggtgatactgggtatagaccccatca

SEQ ID NO: 174 - DNA, 667 bp, Gallus domesticus
taaaaggaactgaattaataaattataagcctgttttctgcccatcttccttttggccatgcagaactgtggccatagcagtttcctgttccatctgcatggccatgctatgaatgcactcccttccacaccgcagggcacaggagatgtctgaagcacagggatgtgctgctgtgctctggacacctctcatcagaagtggccatagctgtgtccctttcttccatgtggggcatccactatccctgctattgccagcactcccagcaagacccctgccagtgccttctgctccttctaaccacagcagtgggtgctgcccccagagctgctcctctggatgctgtgccccacatttcctgaacacacactgcccatccagcaatgtgggacagggaacaccacagcaggaagagacctcaatcacagccatagtggaggcagacagaaacctgtcatttttagctctagacatcacatcactcccatatctccctgtgtctctgtacctacaaaactgctgtcataggccccactaggacaggaacatgaatggggctctgcaaaggcagcgccacagcagctgtggacccagagagcagaactgactgccctcaacagctccgcccatgcagggagatgtgcagcaacaaggaggggaggaaat

SEQ ID NO: 175 - DNA, 175 bp, Gallus domesticus
agtgcctgacacacactgccctcctcctcctcctcatggggaggagaccccagagcacacaagcacacacagaatattcaaacaccgacttctaatccatgcttaacagcaactatgactggtacaagcagaagactcctgacaataccactggcactttgtaatacctccacaa

SEQ ID NO: 176 - DNA, 178 bp, Gallus domesticus
gatgtgaaactctctacagccctgaattaaaacatggatgttttctgcctttctccctcaggatcacgctgggctctgtcactcaggcaggttcccctctgcatggccacggctttgaacatctttcctgttctgcctcattgtataggactctcccagtacctggaaacaccaaaaa

SEQ ID NO: 177 - DNA, 740 bp, Gallus domesticus
aaatgcagacaacagttgtacagtactgcttcccactgacacagagcagcaggtacaactgatgcactaacctcctgccagtgcagggagcagctggctctttttgctggctctgtttgatggcggtgctggttcctaccatggcccttccctcattgccctggactacatgtggcagggcaaaaatcacatccccagcactgacagcagggaacctgtggaccgctgagcagccaggccaaagctccctacttagaggggatgtttcccatggcacaaggctgggctggctgtgtttctcttctggcacgagggcagccacagaatctttcagatcaggatgattgttgtgatctgctcctacctcagctcaactggcatcacctacagcacagtgcccaggcctgtgtgcaggtggctgtcagagatctccaaggaggagactccatgatctctccgggcagcctggatcagtgctacattacctgcggagtaaggatgtgactcctgactctggccagacagaacctctgcgttcagtctgtgccactgcctcctgtactggtgctgaatgctgctggaaaaagcctggctctgttcactttgcaccctcctttcaggttagcgtaagggagaggagagaaaatagggctcagcaattgcccaacatgcacagccctcaccaggctgtcagatgaggcacgcaattccacaaggacacatggggtagcaggataccc

SEQ ID NO: 178 - DNA, 966 bp, Gallus domesticus
tgcaaggagcagctggcaggttttgctgtctctgtttgatggtggcacaggaccccaccacagccctaccttcactgacctgcaacatgggtggctgtgcacggtgtcctgaacacgtcccaacaagatgcacagcactgcatcaggcccagcccctgcctgtagcagctgatgcccttgtccaacttctgccagagctgcctctgtgctgggatgctccatgctgagctctgatcctccaaagtgcccatagctgtggctgggatcccttctgctctgatggtggttgcacattgcaggaacagagcccagaccagaacatcttagtaaggaggcagctccagcagcagcagaacggggctgccagcagcagggaatgatgctgtgccacagtaggaacagggaccaagaggatcacttcccacgcaataaagtataaaagagagggcattcaaaaacacagccatgcagagcagagagaaacctgactcagccccacagtcctgctcagccttaagtcagcaagtgcagaaaacctccatttcaactcaggtctgtaactcagttccacatcctcttttgtctctataccagcattagtgctgctatcccagccaccacagcctcatcttctgaccttagtgacaactaaccacaattggtcttccagggcccagggaaatagctgcactgggacaggagctgccagtgaccatgaggttctgcatgagtgggctgtgttgtgggcagttcagggtataaagaaaggagttggagtccatggcatagacccattggcataaggatgtgcatctgctgggatcacaccatggcctgtgcccctctcctgctggcagtgctgacccacagctcaggtgccccaggaacacccgttgtgcccagcctttgggcactgggccccatccccctgcttttttaagacttggcatcaattcaccacaacac

SEQ ID NO: 179 - DNA, 1304 bp, Gallus domesticus
tcaacaagagcctgacacacacagccctcccaagcagcagtgggatggggaacagcaccattaaaggaaaagggacttcagccatagccacatcaaaggatgagagcccagcccagagcagcccagcacagaggcagctccatggagcagggctggggatgacaagatgctgtatctttacaaggataggtacagtgtgggtaagtgtcagagtaatctctcatacatctaggtacagacaggagggcatttacaaacacggccacgcagagaggacagaaacctgcctcagccccacagcgctgataagccattactcagtaagtgcagaaagtttccatttttaactcaggcctgttactcagttttccatctccctgtgtcactgatccccaacttggactccagtgaaggctaaccatgatcagccttctgtgagctgagaaaaggagtgtagtgagcagggagagcactgcaataggagctgatagtgatcacacaggcctgtactatgggcagatgggagtttaagagtgaattgcggtccatggcatatgcctgtcagcatagggatgctggaggaattgcaccttggcatgagcccctctcctcctggtgatgcttgcccacagctctgacgtcctgggaaggctcactgcaccttgttgtcagtgaaactgcaataagctatcaagatttgatataattctgcccctctgatctacttgtgagaccacacctggagtactgcatccagttctggtaccaccaacacaaaaaggacatggagctgctggagcagggccagaggagggccatgaagatgaacagagggctgaagcacctcccctatggggacaggctgagagacatggggcttttgagactggagaagagaaggctccatgggacctttcagtgtccttccaatacttgaaagggtccttgaggaaagctggggagggacttcctataaggacatatagcaacaggacaaaaggaaagggttttaaactggaagaaagtagatttagtctagatagtaacaagaaattctttacagtaaggatcacgagacactgaaacaggttgcccaaagcagctgtggatgccccctccctggaagtgttccaggccaggctggatggggctttgagcaacctgttctagtgagaggtgaccctgcctacagcaggggagttgaacctagatggtcttaaaggtcccttccaacccaaatcattctatggcaattctatagagaacacctatgctgagagtagctacaagtatggctggttcct

SEQ ID NO: 180 - DNA, 441 bp, Gallus domesticus
tctgtaatgctataaggtgagagaaagtaagcaataatagcagagcagcacaatcctaggctacagcaaatgagaacaagcccagatgcagccacagaaataaagaaaaaaaaactgcttacctttagaaagcctcatatagacagggatctccagcaagatacccacacctccactgccaacccttaaatgagggctgggatgggctggatcctggctccacccctttcaatcactcaggtacattgcacacacctgagctcccctggctggccctgccttcccaccaggtgctcaatcactgctttgggctgtgactcagcatctccactacagcatcacagggagcggttgtcggtctctgctgttcctatgtgggtgccccgggacacctgaaggcatgagtggcagtgagggctcccagctctatccatggtgaac

SEQ ID NO: 181 - DNA, 96 bp, Gallus domesticus
gcctgacacacacagccctccccagactgtgggatgaggccctgtgcccgcagtcacatgtggaatatcaagacacacacatctatgacaatcaca

SEQ ID NO: 182 - DNA, 2600 bp, Gallus domesticus
agggagcagctggtcattatcctggtgacacaagtcccaggcatggcccagcactgtgctgcaggtggctatgccgggtgccctgctctgccctcctgtagagcctcaggactgtgcccatcactcagggaggagatggtcccagcagccttgtccctgccctgcactgcacttagctcctggaccccatctcctgctgcccacccatattgcctccctgtgttgctgttgcagggttgcttctgcctcatactggtttctcccttctggaggtggccaaaagccgggccctgtgcaatcctggtgcataaataccttatggcccctaagtagggcaggtgtgggacacgctctggcacctggggtgtgtgcaagtgctcaggaagacctgcaggcacaggtggcagtggggggtctctggctgtgctcgagcagcagctgcctggggtaagggtagtactctgtgcatgaacaatgctgcagggctcagctctgctcagaccacgaccctggcaccaacagagacctgcctggctctgtggtcatgtaaacctttacaggagctcaagacaaggctgtttattactgctctggcaggaaagaagcactggccatggtcatagagagttccagcaacaggaaagtgagagcccaagctgctgaggtaccagggctcctcaggtgcctgctgcagcagcttggacacagtcgaggaacagcaattgtacctgtgtggtggatcaggctgtgctgcctgtgaacctattctagcacatctgtcacctctgtgccactcacagggataccacccctgagacccctaccccatcagcctctgtgtgggatatggtgttgggcccaagggctctgttgcacagggagatagaggcctggggaggagggaaagcattgaggtggtgttgataccagggatgtgagcccaagcaagagatcagcagagcaaggaggaagaattgcaggtgttggggctggggaaagccccagatggctggagctggtggggccactggagatctcctcctcccatcctgctccatgctggggcagctgctgcaggctgaccagggcctgcccgggcacgttgtgaaggtcaccaaggatggagacttcagagctatctgggacacgtgttttaacgtttgatcagccttgcagcaaaacagtgttttgctctattgaacagtgttcaacaaaaacgatcagtggcctggaacacatctcctacgaagaaaggttgcgagagctgggtctggagaagagaaggctctggggcaacctccctgtggcctgtcagtgcttaaaggaggctcaagagaaagatggagagagactttatacacggagctgtagcaatatgacaaggagaaatggtttaaaatggaaagagggtagatttaggttagctatcaagaagaaattcttcactcagaggtgatgaagcactgtagcaggttgcccagagaagtattggatgcttccttcctggcagggcccaaggccagactggatgggttctgggcagcctgttctggtgggagatgtccctgcctgtggcatggcttggaaatgggtagcctttgaggtccctctcagcccaaatcattctatgttcttgtggttccctgcatttcagcctttgcctgttgactctggtgccactgttggacaattctactcagctgcgtttcatccctgccccaaagcagtaatcccatggataagcaatgctctgaggccttcaccaccctcagggctcctgctgaccctagcggcctccctggcagcatgagccctttgttgtccgcactgctgctgctgagggtcctgccagccccccagggccttttctgcccaggcactgccacctgctaaaacccagcctgcccatggcagggcatcgcatgtctgagggatggaacggggcaagggcagtgctgcaggcagtggttcaagaaacgtttagatgttgtactgagggatgtggtttagtgggaaatactggtgataggtggatggttggactggaggatcttagaggtcttttccaaccttggtgattatgtgattctatgaagggagccatagcctgctcccatcatgccccgccagtccggctctcccgagcactttggttccgcagcatccaggcccgctctggggccggtgtgggcctgggtgctgccacgtgtccccgctgcaaggcctggccaaccccgctgtgccacaatgcaggggctgggctaggagtgggcagggaggtgtggggagaggcgtaggacgtggctgggagcgcagggagttatttgcataggggggcgtgctgcggaaggacgcgggtataaaagggcatcgaggtccccggcacagccccatcggcgtggggacacacagctgctgggattccgccatggcctgggctcctctcctcctggcggtgctcgcccacacctcaggtactcgttgcgcccggtcggggactgtgggcacggggctctgtcccattgctgcgcgggcagggctgtgcgtgcggggccgtcactgattgccgttttctcccctctctcctctccctctccagg

SEQ ID NO: 183 - DNA, 1808 bp, Gallus domesticus
gtgacacaaagcaatggggaaatgatacaaaaacctcctgccagtgcaaggagcagctgatggtttttactgtctctgtcttacaagtcccacctccattcctgccctgtgctgcagggcccaggtcctcctgcattcccaggctgcaccccaggtccagctggctgcctccctgccatccaacatccaccatttgtagtgtcccctgcatgcaccaggctggcagctcctcatctgctcctgctcccactgagaccacctgcccagcccatgctggagggccaccaccactcaattgcactgcacatcagcacagcaccagttctcttacatgtgtccctctgaggaaaagagctggacttctaagcacccttagtgtactcacctaaaatgaaactgaaaccccataaaagtctcagaaatacccagaaactgttcatccatagtatatggcatcaactttagctatatacttttcatagatagtttcaatgagtttctatcacttgcaccggtcacttgcacctaagccttcccagaggaaaaccaaacctttgaaacagaaagtacttccaaccacaaaatctttgatgcatcattcattttctagtgactcaggagattcaccaactctgcctctttctataaccacttgcacaaaccacagcatttgcatatttgtgagtttatttttaagccagtgccttggctctggcagctctggttgggcatcaacatcctcttcacattttcttttcctctcttgaggaggatgtgggcagcatgtgcagcgcagtggtgcaccaatgggataaagctgggcccagtgacctcgaaggacaacatcagcgagagtaaggccatcaaaacagacaggcctgaattggaggggctgcactaaaactggatgacaggcaagaacattatttggtgggttcttgtggcaggttgacatgacattggccaagaccttgaccaacaatggcacagctactggatatcccttggaagaggtgaggaggacacacagacaccatctacactctgtgacccacagcaggcagcagggctcagccacacatgagcgggcatgggccgctgcttgggctgtttctgcacggccatgtatcactgcaggtatttccccggtgggacctcaggaatcaactgatcgtcctcaggaagtcgctctgtgttcacttacagtcctccccagcagtaagtgggtgctcaggctcctcacagcctttttttttttttttggttggttttgttttctttgtccaactttggctgtggcagtacatccttggtctgcctaaccacactgaaatgtactcatgcacctttccctgatttgcagaaagaaggttgtatggtctgaatgctctgtgctgttgcaagtctcttctggttcttcgaaatctgcagagtccctcccgactgtgtccttggtactgaacatccttgttcaccgtgtcagaaggcagctggggggctggaggcagtagtgcgtggcaccaggatcccctggggcatttcttgcctgcggcgcctgggtgctccacgtggctgccagggggacacacctcctgtagcagcccccagcaccaccatcctgctgtgtccattccgtcaccttgatcctactgtgtccagcccatcgtctcccttctgctttgcctgtcagaagaacacttccatcccatcacttctgacccaccccctcatcctgccgcctccacaggacccagaactgcccctgccacgaagtgggaggtttttgcattgctccgtatcactgtgtg

SEQ ID NO: 184 - DNA, 1739 bp, Gallus domesticus
gtgagtcgctgacctcgtctcggtctttcttcccccatcgtgaaattgtgacattttgtcgatttttggtgatttgggggtttttcttggacttggcggcaggctggggtctgccaccggcgcagggccgggcactcagcgcggcagcctgggctgagtcttgtccccaccgagccggagggctccggtgtgcgccatggaggacttagggttattttgtcaatggaaagttcttaaaatttgaccagaaaatgtgcccgaggtctgtctctgccacacgatttcagaaattgtgtctaggtcgatgagaagacagtttttgtctttgtcaggaaattagttgtgagttgttagtccttccctcttagtcctaaggactaagacctttgtccccggtctggtctctcactggggactcttggctccagtgccatggggagcccaagtgtcactgacacggtgtccttgggggtgaaattcagtttttcagctgtccaggtaagtgctgtcaaaaaatggaggttattctgctgaaaaagctgagaggaatattttgtcatttttttcggaaatatatatatatatatatatataaatatataaattatttatatattttatatatatatatatataaaatatatgtatttctctctttctttttatatatatatataaatatatatatatttctccctctttctttatatatatttatagggagagaatctatatttttggccaatttggccaatttctctctctctctctttatatatatatatatatatatatgtaatttatatatatatatataaatttatatttatttatttatttatttatatagattatttttatatacatatatatatataaatttggccaatttagaagaaattggccaaaaaaacccaatctgaaccaaattacttagggcataagtccaaaaaaaaagtgcagttcaagaattcctcgctggaaagtttttaatgggggcagttcttccccattttctggtgtagatatgagtgaagatatagatatgtatgtagatatagatttggctatagtttgtttgatgaacagtctgaggaagagtaaatcttgccttcctcatggcaatttttaattctacttcttctgagacaagtctgaacatgccttgaggtagaaagagcccgaaaattgagtgctttttctttgaaattttaattaaaattaaaaaatagccttacagcaggaaagaaagggggtgatggcagctaatcggagttccaaagctgaaccacgttcacccaaacacgtggttgaaattttgtgtgtgtatatatataaatatatatatgtatacaaaagaaaatgcctatatataaaaaaattgttatgtatattatatagatttattatagatatgtacataagatataacacgtatacatatatatgtagtctgctgtatgctttgtataaatttttatagatatgatgtatattatatgcatgggttatatatctataatatattttatctgtagaaggaactacagtataaaatgcatatatgcgtatatatacacatatttatatatatgtgtatatatatgtatacgcacacgtataacatccatgaaaatagatatggatgggtggatgtgtttgttttacagaggtgcatgtgtgtctgtacatacacagccatacatacgcgtgtggccgctctgcctctctcttgcagg

SEQ ID NO: 185 - DNA, 9858 bp, Gallus domesticus
tagtcccactggggatgcaatgtgaggacagtggttcctcaccctccctgtccctctgggccgctgctggtggcagcagccctcacttcccactcagatgtcccccaccgtgcccccatcacccacctctgcctgtcgactcctcttgccctcatctctccaggtgtcacattaataaacacgacactgaactagtgctgactctgcatccatgtctctgtgtccttttgcgtgctgtctgcatctcacacaggggggtcggccccagtatggggaagggctggggggcgcatacacacatattggtaatgttggggacgggggggggggggtgggggggtcaacagatcagcactggagacactggtgtataccctggcaccaccaacatctaaggcagggtgctttggggcaattttggggcagtttaaggtctgtgctggcactgagcacgtggctgtggccgtgctgtcctcatctcccacccactacggtctgtgcgccaggtccctagcagagatttgctttatgctgggaacagggggagttctggctctgttcccttgcattcagacaccctggtgccccctgggtgggatgtcagtgtgaatactcctttgtgccctgtgcctgcagcagcctgaccctccacacaccacacgccttgtgtgcaccccacccctgtcactatccctctccccgctccccagggagattttgcagtggcccctgtagggcagcttttagcacagcccccagcagcaagcaagcagaaagcactgctgtgcacagcttgtcagctgtgtgtgtttgctgaggaggatctgtcttttgctgaggccatcagtcttgtcctgctcaacctccatcgatgctgcccacctcaacacatctacccatctattccatctacaccaacatctccattcatcccacccacccaaacatgtccatccatcacaacacctccatccaacccgcacactccagcacctccaatcattccatctacaccaccatgctgatctgctacagccactccaacgcaaccgtccattccatctacaccaatgtccatccatcccagccactccagcacctccagccatcccacccaccctatgtctccatccagccactggtggggtgcaggacatggggccagctctactgtcaggactggggtttttgcatggccccataccacttctgcagaagagacgcactgaaagtttggctgaccattttctccacggtagagttgtggcagttctgtaatttagggtcttttatccagtttggagatgggctgggatctcccagctccatggcaggcattcatgacactgggtttagtatctgatgggtgggatgtggctgaacttcattttctttccccagtgacaaagtttttgcagttgaatatgaattcctgctttctgctctatgagttgtttttttcccaggacgtacacagggaatcagcagtcttcattctccctctgccatgtgtagactctctgccacacaggactgtgctgtcctcatgcccctgcgcccaaattgctgccctctgcccatgcctgccaagctgagccctgcaggctgccatgctggattgacatgagccctgagattggtacagaaatggtgattttggggttttctttgcactcaggaagctgaaggctcaatgctcagtgatggatttaccaaactgtgccctgaggcagctgctcatgctggataaagtcactggagcacagggaaccaggcgctgggcagggatttctcatgggccccacttggaaagctgcaggctgcaaacctggctctgccttcacgcctcaccctcatgaggacaacctcactaattattgattaaaagattttgctaaaccatctccagaagcaacaacccactgaggagcatgtgctgaattatacatcacagctccacggccctgccctcatagcagggctgcatggcacccacagtggcactcagagggaccacagggctgagacagccgggtctggtggtggggacacagctgagcataggatgagccccccgggcagtgctgggctttgctaatgagcagaagtatggatagaaagcaaccccagggctccgtacccagctgcagctcttgctctgtcgtgtcctttggtgaaactttaaacagtcgcctttttttttctctttcttttctggcttgccattaatttcaaaccgagagagacctaatttagtaaatgagatgcttcaggaaggctttaattagctgcagatggaggcaggcagtgctatcgtggggcctggatcgcacagggggctgcatatcctcactagcagaatacactcaggctgggtccctcccacattcatgccccagaccagagggaatatgctctgttccccacacatcgctcccaatcttgcagccgttgagccccaacatcccaccagcacacggggctcagcacgcctggcgacatggcatcagcagagcaggccgcatggtacagctccatcagcacagctggggccacacaaagagctgggttactgtgggcagcaggctgaaacccgaaaacaagagctgggggctcagaatagccccgggagcaggcagggcctgggggtgagggcaagcaccaggcccagggccacacagcccttccaggaaggcacagcgctgtcagggtgcagcacgctcagccccaccatgcagctgtgcggccggggcatccccaagctaaatttacttctcagtctccaatcagaaactgaagctgaggggcccacaccggccaaaaaaaggaaacgaaacagtctccagaaagcactgacgtgtgaagcagagcgagcgccgcgcaaaccggccgccatgtcacacacctcaggttggggctttgccagactgagctttgctgctgctcggggtgggtgcccacggcctgggcacatgggatggggtacacacgtacacacacttgcacacccacaccccaacacttcaggtgatgctggtgcagatgggtgccccccaggctgacccccccacgcatgggcctggccccacactgctccatccgtgtctctgtccccatgtgccacccctgcccgctcccaccacgcgtcaccccaaatcctgagttaatcccacgactcctgcctgcttccagcgtccatggcagactggagatgcccaaaatgcagagcaggtttccctgaatctgagagatgaaatggagttatgggtgttcccctgcggcggagccccagctgtaggaagctcagagccatcacacagcaattaaagaggaattaaattaaatcaataaatgttttaggcgggctcagctgccagcaccacctgaccgaaacagcccgcttgcaaagaggagagcatttgcatggctgtggcaaaacagcaaccgcctgttgtgcagctgggatggtgttatctggaaatgtacgcagcccaggaggggtaaacagctccaaactgagaccccgaacttgtccacaggttgtaaacaggctgacataaacacctttgtgccgtggaaaaatatttatcacctcaaatatagcaggttaataaaataaaactcccaacggagctacacacctgctttggaagggaagcagacacttgttttctgcttgatgttggctgtaggaagccatgtttcccgatgcaggagggccacaaagcactgacaacacaatgtgagctgagcttcgcccctgtttaagcccccacctcagggcttgtggtctcggagcaggcaggacgcaggggtggcaccgggctgggtgacatgggctggtcctggggtgtctcactgagctctttggggaggggttggagccctggggcaatcacagcacacacagaggaggtggggggatgcagccagcagctgccctgcactaagaaaaccccatccgtgggctttcagatggccttcccatctctctgcagcctctgcatgggctgaacacaaggtttaagtgtttctgccatgtttttggggcatgtttggaggggcagcgtgggcccgggcatacgggtactgccacgtgccgccagccccacagctgagcctgcactctcccagatgtgctgaccgcagccacgggggcaacagtttctcttgctaaaaattgtagccgggaagaaaacacgtggcaacttcggccaaacagcagctggaggacaggaatagccgtggccacggcacgctctgcttcctcggcacaaacattccagtacgtggcaccacgagcgccgctgcccggcacagcagcaagcagagccaggagcaggaaatgctgatttgggccccattttggccatggctgagagaagaggcttccagggagctggtcagcttggtccccaagctgtggcttggggaaatgatggggaggggattgccactgcccaccctgcagagcaggctctggtcccatctcactgcagggcaccagggcgtttgcactgcagcaattcacagaaacattgaaatggctcctgccttgttcaacatcttcatcagtgacctggatgaggggacagcatccaccatcagcgggttcactgatcatatgaagtcgggaggagtggctgacgcaccacaaggctgtgctgccattcaacaggacgtggacagactggagagctggacagggaggaacccaatgaggttcaacaatggcaagtgtaggatctacacctgggaaggaataacagcatgcatcagttcaggttaggggctgagctgctgcagatgagctctgagagaaggacctgagcatcctgctggacagcaggctggctgtgagccaccggtgtgccctggtggccaagaaggccagtggtatcctggggagcaccgcaatgagagtgggcagcagggcgagggaggtgaggctgcatttggagcaccgtgcccagttctgggctcctcagttcaaggcagacagggaactgctggagagagcccagcagaggggctgcaatgatgatgaaggtcctggagcatcgcctgtatgaggaaaggctgagggacctgggattgttcagcttggagaagagaagactacagggcaggagccaagtggatagggccgggctctttccagcagtgcccagtgacaggacaaggggcagcaggcacaaagtggaacataagaagttccatctgaacatgaggaaaaactgcctcgctttgagggtgtctgagcactggaagaagctgcccagagaggtggtggagtctcctctggagatattcagagcctggcaggacactttttgctgagtaacctactgtagggaacctgacgcagcagaggggtcggactggaggatctccggaggtctctttcaacccctacagttccatgaaatacctcaaacactgccaagcgcagtgctaaggcaagggtaacatttgtaaactgaaacagggtgggtttaagttagatgtaaagaagaaactcttcactcagagggtggcgaggccctggcacaggctgcccatggaggctgcgggtgccccatccctggcagtgcccaaggcaagagcccagcagtgaccacagccccacaaggacgagcgtggcccctcgtatctcagctcaccctgccccagctcaactcccacctccggcacagcgcgggcacacagccgggccctgtgcttatggagcccttggggcaggtcagcactcacaccctccaaacacagccgtggctcccaaccggaggcagctggatctcggcagccataaccaagcagggccatgcgggggtgacaccggggtcccccaccccctgtggggcagcgtatgggctgggcccctgctccagtctgcagcgtgtgcatgggaaccatcaccagacaccatctagaccacctgcagccctaagctgcctcacagcagggattgctccgtcacaccgtgaccccgtgcccttattccatcacttacggggctgggagtgcctggaccttgggcacattaacgaggatttcccgctctgccctcgctttgctccgagccgtggggctgtgtagtgcagacacagctgcagcctaaaattagcacctgggaaaggcccccatgctgcaccgcgcagggctgagatgtgccacgtccccatggccggagctggggaaggcaacgtggccctgtgcgtgtgcacgctgagcacaaggacacgtgctgggccaggatttgtctccccggggctcacgctatgtgtcaccccgtgctgtgccatcccctcccgcagcccccagctcccccacggccgcacgccgcctgcatccctgcaacggcaccgcacagagacacggagccaggggccgcacacggggccaggagctcacctttattgcagccctgacagccccacggcccagcccatagcggggctgccacatcctcacccggccgacggccccagctgctccttaccatttcttcccccatcacccataaaccagaagccgcctcaccgctacgcggagcgggcagcagggaacccgggccctaagggggagacgagagggggccgagcaggggcaggaggagcagcagggcgagggggcagcgggggcacccacagctggccgtggcatcccgggaggagaagaccttgcggctgcggagcggttgtggcggacggaaattgttggtcatcttcaggggcgcagcgcccgaggccgggaagtgcacggtgctgacaaacgcctgcagctgcggggagagcaccgcgggcgccgcagccgtgaggcgtagggcgaagcggggcacacgcgtggctgctgccgggcagagcgcagcgcaggagccccgtctttccccctaccggcagcacacggctctgcacacaccgcgcttcgtgccgcctcgcagccgacgctgcaggaagcccagccgagcgcttacagagcggccgggaaatgcatctgctgaggtgcccgggcaatgcagaacttcatccatccccacatccattcaccagtcccctcccaaacccccatgcccatccggcgacccacccaccctcctcttggtgcccctctcaagctctccatccccacattcctacagatgtcccctttactttgcctgcaaggtgcaagaaaacgcacagggaccgggggtgctcacagcacggctttggccagacgggcccttccatcccatggcagcagggccgaggaatcccattacctgctccctgctgatgcccacaggctcctcaaacacggtccagatgacggcctcgctgcagtcaggggttgtcagggagccctggtagcggtagtaccgggacagctgtgcaacgtgcggcagcagcgtgccaaggcggaaggtggaggccaggtccactgcctgccctgcacagcaggacatgggcactcagccccgctgcccctggcacgccccagggtctctcccctcccagccgtgccccattgcagagcaccagggcacctcaccagcatgggagatgttcctcagtcccccaatgatggtgttgtagttggagtttggggcttctgagacctgcaaagagcgagtgggccctgcagctgtgctcatttaaggccaacgcatggcagcacccatcccatgcactttgcagccaacctggaagaagcagcccagcacagccagcccgcttgggtgccccttggcctcccccagggtgcggtacttgacgttgatgtggacgatgtgcagctggagaaagaaagcacggagggctcagcagaggcacccggcctcgccagcagccaggcaccaggatgggaaatcaaagggccgtggtgctaaggggcttcttgcctacctccatggggagctgctgcccatccacggtgtgctcagagccattcgtagacaggctgccccagtggaagtgcagctgcagtgcacggtagcggcccgggaggcccccgccactgatggcaatgtgctcagcacccggctcgctctccaggctcagcatcactgcaaacgataggagtgggacaggactgggggccgtggggcagcactgctgcagagctgagccctggctggagcagaacacccacccgtgtgcccatcgttcagcagccgccacttgccggggggtgcctggtcatagccctcaaagatgatgtccccaaggctgccgtcccgctgcagccagcgccggtcgatgttaaccggagactgcttgtcaccgccgcaggtggccttcagctccttccagtggctggggcctgcggggagcacggccatgggggcacccgcagagccaccagcaccacccccaggggggacacagagccaagggcagccctgtccccaccacggaccctgccccatctccagcccttctctccccgttactccaggaaggttttacttggaaacctgtggagctgtaacccgccccgtgagctccccattacccaccgccttcattaagggatggtgccctcagcacgtgcctgttctgtgctgccccaaccgccccccgccagccccagcacggtttaattgctgctggagccggctctgtgccgggcagtgaggctctgagcgctgctggacgcagctgacctgcagcacagtgagcacgcacctgagggctataaagcaattgggctgtaactgctgattacatgctccctgatccttaattaacctcttacaagctattatacgtgcgtttccaaagtgcccccgggcactggggagggaggcaccgaacagagctgtgaccgtccccactcaccgcacttcgggtcctgcgagtcgtagcaccactgccctgcgggagagagctgtagtcaggggctgcagaggcccccaaagcccccccatactgcggatctctgcacagcacacagcgtgaccgtgggcagaggtgcgcccacaccgcccggagcagcgctacgcggagccgcttccctcccacctcgctgctgtcagtgcagggacacacagctctgctgtgttgggagcggggtgaggagcgcggctgctgcccacggccgctctgctccgctcatgtcccaccaacccatccaaatccccgtgtgggaactcagccaccccagcactccctgcctacagggatggttccccgctgaccccgtgctctctccagccacaggccgcaggcagcgctgcgtgcaccgcctgtgctgctggcttcgcatccatgtcctcaccacgctgctatgtgaggctgcagccacagggctgggaacagggactgtcccagggcagtgacttcaggctttccttcccatccagcgggaactgagcctcctgcacaccctcagagccacaaagcgctgccctcacccaactgtgagcatccctggcgtgagccaggtgggcgctctgctctatagaagggtgctgcgcactccagccccatttgctctgaggtgtcgtcctcagtggcatttccctgcttatgagtacatggggcagaggggctgaaacctcaatcccagctgcctgattgaccgtccgacatcccagacacctcccagcagggctgacacctccctgagcccggcagcacggcggggacaggggtgtcccacggggagggcacagaacacagctcctgggctgcaccacatctccgagcgccacagacatgcattccccccaacatgtgggaaagggaatagagtgctggcactgccgtacccccctcccggcaccatgctaccccataacccccaagccacctgcactccgtgcccatccctccgcagccccaaccacgacggtgcagcagacgggcagcgcat

SEQ ID NO: 186 - DNA, 36259 bp, Gallus domesticus
agaggatcctattaattgtttgttaattaagaggacaggaattcagtgtcagggggctgctctttgcttcccaatgtgtaccactgaagcctctctggatttatcagagatactcaatggactcttaacagcactgtggcacctgacctcctgctgccttcagcctcccttcctggctggtgtgcttgtgttgaggagctgtgggaggctggtgcagttctgtgggatgaggtaaggccagctgaatagcctgggggctggtcagggggcttagtgagaggagcagggctggggaatattgtgaacagcaggtggtgccactgctattctgaggaaggaggcagcttctgcaaatgctttgcaatgcaggatgacaaagtgcttctgctagctctaggcccttgctcatggctgtgatggtgcttaacggtgccagagtgcagacaaatagatgtgtacagctgctctgggagtaacaacaacaactatggctggtaccagcagaagacacctggcagtgcccctctcactgtgatctatcaaaacacaaagagaccttcaggtatatctttatacttcagctggtaccagcagaagacctctggcagtgcatctgtcgctgtgctgaaaccaacagacacaccaacaccacaggacagcttcttgcagttctccatctcctggtgcagcttcatgagcacgttaaccatcgtggggattcaagctgaggatgtagctgtctatccctgtggcaacagggacagcagtggtaagcctggtgaggtgatacagggagatgtcaaaaaaaaagaaaaacccaacatgtatggggttaaaaatggaggctctctgcccttttctctcatggctgagctgggctgtgcagtgaggtaagttcctgtctcgtctgcaaagcactgtctgaatggtctccctattgtgtgttgtggtgcatgagggattctggggacagagggcatttgtctgtccctataaaggcccaaagcccctggctgtgtacagtaagtccgcctggggcacctgagctgtgggcaggtactgccaggagaggggctcaggccatgatccaataccaatggctctgtgtccccatgctaatagggctatgctgcagcccatcactccctcttaaaccccctcttaaacttcctacagttctaagttctatctctctcctccaattaatcatcgtcaccatacagcatcagtgctgtcatcccagttcccccagtaatagacagcctcgtcctcgacttggaccccagtgatggttaacgtgcttgtggttctgcctggggagccggagaatcgtgaagggatgttcgagggtctgttggtgttgtcatagatcacagtgacaggggcactgccaggtgccttctgctggtaccagccatagtagctgctatccccggagcaggtgatctcaacggtttctcccgggttcgctgacaccgaggccggctgagtcagaggagagaggggagaaaatggagctcagtgagtgtgcgacacacacagccctcagcgtactgcggtgggataatacttctgagcacacagtcccaaatggaacctcaggactctctcatctgcttcaggatgaacaatgtctatggctgctcccagcagaggactcctggcagtgcccttgttgctgtgatatagggggccagcaggagaccctcagacgttgctttgtactttccatgttccaaatcctgctgcatgcacaaattaactctcgtggagattcaagccaagggtgagactgtctattactgtggtgcctgggaaggcagcagtaatcctggtttggtgatacagggagatgtgcctccccccaaaaaaaccccaaacaaacaaaaagcatatatagggggtaaaaatggagtttttctgcccatctgtctcacagccaagctgggctgtgcagctgcggcaggttcctggcctctctgcaaagctctgtttgtgaatggccttccttcctcttgtaccttgtggtgcaggaggagattgtggggacagaagccacttctccttgtccctacaaaggcacagcactgtgtcatccccagccctcctccatgttactgctggcagtcccgtcctcctgcttctgaagagacatggatgtaggtgaggtctcttctgcaacagtggtgttcatcaccccacagctgccaggtgagggctgtgtgtgtcggacatttggctgagctccattttctctcctgtccctctccaggttccctggtgcaggcagcgctgactcagccatcctcggtgtcagcaaacctgggaggaaccgtcgagatcacctgctccgggggtagcaacaactatggctggtatcagcagaagtctcctggcagtgcccctgtcactgtgatctatcaaaacaccaagaggccctcgggtctctcttcataactttcttgttcctcatctggctctgcaaacacgttaaccatcactggggtccaagccaaggatgaggctgtctattactgtggtggctgggatagctgctgcctgagtcagtgctgcctgcaccagggaactgggagaggagaggggggagaaaatggagttcattgagtccctgatatacggagtccttgctaggcaatgagataagacagctgagcccacagaccatcttttactacagctggtaccagcagaagacgcctggcagtgcatctgtcactgtgatctatgctgacaccaacagacccaccaacaccacggggcagcttctcacaatcctacacgttctggtgcagcttcatgagcacattagccattgtggggactcaagctgaggatgtggctgtctatttctgtggcagcagggacagcagaggtaagcctggtgaggtgatacagggagatgtcaaaaaaaaatgaaacaacatgtataggagttaaaaatggaggttttctgctctcttctctcacaggtgagctgggctgtgcagtgagatgagttcctgtcccctctgcaaagcactgtctgaatggtctccctgctgtgtgttgtggtgcatgaggagagtctgaagacagagggtacttctccctgtccctgagaagctgctgcatggtgtcatccccagccctgctgcatgttacactgtctgccctgtccttctgatgccgaagctgcttccatgctgggatgctctgggctgagctctgattctccaaaatggcagtggtttcttctgatggtggtggtattcctcattctactgctgtgcagggagggctgtgtgtgtgttggctacccactgagccctgttttctctcctctccctctccaggttccctggtgcaggcagcgctgactcagccggcctcggtgtcagcgaacctgggaggaacagtcaagatcacctgcaccagggatgacagctggtatggctggcacctgcagtgaggggcattgaggctgggaacaatgcagtgctgtgcctttgcaggaacagggataacggggcactggacccagaattgattactgaatgaaaaggttcagtaagagaggacatgcgtgtgatgtacagtctggcagaagggactggattctccctcagccctgactcaacaagggcagaaagccttggttttgaatcgcagtctgcatgtcacccccacatctccccacatcactataccagcactattgctcctgtcccaatcaccacagtaatagacagcctcgtcctcgacttggaccccagtgatggttaatgtggccgtggagccggatttggaaccggagaatcgtgaagggatgtccgagggtctgctgctgctatcataaatcacagtgacaggggcactgccaggtgatttctgctggatccagccatagtagctgctgctaccagagcaggtgatcttgacagtttctcctgggtttgctgacactgaggttggctgagtcaggttactttgggacctgagccagactgtacctgtccctacaaaggtacagcactatgtcatccccagccttgcttcatgttgctgctgcaagccctgttctcctgctggagctgtctctgtgctgggatgctctggtctggactctcatcttctaatgtgccggtggccatgactgaggtttcttctcctttaatagtggtgctccctttcccactgttgtacgcagagggctgtccatgtggggtattccctgagccccactttctctcctctccctctccaggttccctggtggaggcagaactcattcagccgacctcggtgtcagcaaaccctggggaaactgtcaagatcacctgcagtggaggtatcggccagtggtatggctggtaccagcagaagtcacctggcagtgtgcctgtcactgtgatcaatgctaacaccaacagaccctcgaacatcccttcacgattctccggttcgctctccgtattcacacacacattaaccatcactggggtccaagctgaggatgaggctgtctattactgtggtgcctacgacagcagctatgttggtatagtgccagggggagatgaggcggtgaattgatggccagagctgaaaatgatgggtttccacccttctccattatgacttttgttgagatctcttctcatgatggtcttccctggttttcctgtggttggaaggagcagaaggcactggcaggggtcttgctgggagagctggcaatagcagggatagtggatgccccacatggaagaaagggacacagctatggccacttctgatgagaggtgtccagagcacagcagcacatccctgtgcttcagacatctcctgtgccctggggtgtggaagggaatgcattcatagcatggccaggtggaggtaagagtaacatgcctactgcagtaattctgcacatagagaaggaagaaagacagaaaatcttcctacagttctaagtttcctctctcttctccaattaatcatcatcaccatacagcttcagtgctgctatcccagctcccacagtaatagatagcctcgtcgtcggcttggaccccagtgatggttaatgtgcttgtggagccggatgtggaaccggagaatcgtgaagggatgttcgagggtctctggttgttgctatagatcacagtgacaggggcactgccaggagacttctgctggtgccagctatagtaataacttccatcatcgctgccacccccggagcaggtgatctcgacggttcctcccaggtttgctgacaccgaggccggctgagtcagcgctgcctgcaccagggaacctggagagggagaggagagaggggagaaaatggagctcagtgaatgtgtgacacacagccttcagcatgctgcagtgggactgagcaccagcacttgctcagctccattttctccaggttccctggtgcaggcagtgctgactcagctggccttgatgtcagtgcatctgcgtgttactgattacaggttcagctgctctgggagtagtggcgactatggcagtaactgtcagggcagcaccagcaaaaggcatctggcagtgctcctttctatgtgctgtacctgaacaccaacagaccctcgaacatccctttgcaattcaccggttccaaatctggctccacagccacattaaccatcactggggtccaagccggcgacgaggctgtctattactgtgggagtgaagacagcagcggtactggtgccacagtgacacagagcaatggagatgtgatacacaaacctgtcagtgcagggaacagttggcactggcactcatctactcctggactcacaactactatggctggtaccagcagaagtcacctggcagtgcccctgtcactctgatctatgctaacaccaacaggccctcgaacatcccttcacgattctccggttctggatccggctccacaaacacattaaccatcactggggtccgagccgaggacgaggctgtctattactgtggtggctacgacggcagcactgatgctggtagtgacggggagatgtgaaactgaggtacagccctgaattaaaaacgtctgttttctgcctttctcccttatgtttgttctgggctgtgtcactgaggcagttttccctctgcatggccatggctttgatcatcttttctgtcctgcctcagtgtttggaaggtgactctcccagttaccgcggaggaaccatgaagatcatttgctcctggtgtagcagtagctatggttgtggctgcatctggcttcaacagcaagttaaccattactcatgttgaaaccaaggatgaggctgtctaagatgtgtgagctagcatagcagtgaggctggtagagtgacaaagggaagcatagctgtgatgtctacttctggagtgcactggggcatgaaagcgaaaacagtcaaagccacaaccacacggagggaacaggaacatgtctacagccataactctgcgtggccaaaatgctgaaagtcagaaaaccagcagggagcggggctgggtgcagtgcatgccaaccctttgtggggacagctgtagaacatggaattcaatctcagtggagtcgaaccaattggcaggctgtcagcagaggcattccccagtgctcccctttgtttaatgtgaaattacaaacaacgctgccaggcaacaaactgtattgatctgcttgagggtaggaaggccttgtagacagatgaggataggcaaaaatcaatgggctgtgtcaaacccattgacgttcaagaacgttaagtcccagggcctgcacttaggtcataacaacacaaggcagcagtgtaggctgaagagatggttgattagagggttctgttagaatggttcaattctgtgatcatgaagataacttccaaacaaaattggtgtaggatagggataaggtgctctggccccagaatcacctgcaacaaaaaatacagcagggagggcataaacaattgcggccctgcagaggggcagggcatctgcctcagccccattagtgaagggatgcttaagagtctaccggtgttaccatagatcacagtgacaggggcaccgccaggagacttctgctggtaccagccataagcatcgctactgcctgagcaggtgatcttgacggtttctcctgggtttgctgacatgaaggccagctgagtcggtgctgcctgcaccagggaacctggagggggagaggagagaaaatggagctcagtaagtgcctgacacgcaacacccagtgccagaagatagcactgatccccaagacaaggagaccatgcatgccaaagaggttcctctttctctcccacttcctctcagtccggctctagggtctcccctccttcctcctgctctccttcaccctgtacatcagatcccagggctttgctgcatttctgctcctgcaggcattgcctggggccctgtggcaagaccagggatcagtcactctgggagtagccatgagtatggctggttccaggagaaacctggtagtggtgctgtgactgtgatccacagtgacaccaacagaccctcgaacatcccttcacaattctccagttccaccccgcagtgccaccaccagcatatccactatcagtgctgctgtcgaagctcccacagtaatagacagcctcgtcctcggcttggaccccagtgatggttaatgtgcccgtggagccggatgtggaaccggagaatcgtgaagggatgcccgagggtctctcatcatcccagtagatcacagtgacaagggcactgccaggagacttctgctggaaccagccatagctatagctgcccccagagcaggtgatcttgacggtttctcctgggtttgctgacaccgaggccggctgctgagtcagtgctgcctgcaccagggaacctggagagggagaggagagaggggagaaaacggcaatcagtggctgcctgacatacacagcttccccccgcaaagcagcaggacagaggccccatgcccatacaggcccaggtcacctgaactgttggtgaccatcactagtaggagaggggcccagaccatggtgctactccaacagttgtgctatggaccccaactcccttttagacccccacccttctacagcacagccacctcctgcaagcctggtgtccatggatactggccacccccatcccatgctccccttgcctcctgtagccattttccttgatctcagaagaccaatcatggttagccattactgggatccaaaatgagcacaagactatctactactgcggtagcttgggaaacagcactgatactggtagaatggcacagggagatgggaaactgagttacaaacctgagttcaaaatggaagctttctgcacttactgcattatggctggacagggctgcaggggctgagtcctgtttctgtcctctctgcacggccctgactgtaaatggcctcctctctcttcttaaccacaatgtacctgtccctgcccaggcacagcactacgtcaaccctagccctgctccatgttgctgctgtgagctcctatctccttctagagctgcctttgtgctgagatgctctgtgctgggctcttgcccacaaacatacctatgtctgtgactgaggacccttctcctctgatggtagtgcttcccctgcggttggggagggcagggcaaattgggcacctgttgagccccatttactcccctctccctatgcaggttccctggtgcaggcagcgctgactctgccagactcattatcagcaaacctgggagaaactgtcaggataacctggtctggaggtagctatgattatggttggcaccagcagaaatcacctggcagtgcccctgtcactgtgatctataacaacaacaagagaccctcagacatcccttcacgattctccggtgccctatccggctccacagccacattaaccatcactggggtccgagccgaggacgaggctgtctatttctgtggtgcctgggaaagcagcagtaatcctggtatggtgatagggggcgatgtggggggaaaaaaaaaaaaaaaaaagacacatataggggataaaaatggaggttttctgcccatctgtctcacagccaagctgggctgtgcagctgaggcaggttcctggcccctctgcaaagcactcgttgtgaatggtctccctcttgtacagtgcagtgcaggaagagataccaggtatgtccagacctgtttgctgttactgctggcagacctatcctcctgctttgaagaggcatggatgtctgtgaggcctcatctgccagggtggtgttcctcatcccacccctgccaggtgagggctgtgcgtgtcaggcaaacactgagccccattttctcccctctccctctccaggttccctggtgcaggcagcgctgactcagccggcctcagtgtcagcaaacctgggaggaaccgtcaagctcacctgctccgggagtagcagtggctatggttatggctggtaccagcagaagtctcctggcagtgcccctgtcactctgatctatagcaacgacaagagaccctcggacatcccttcacaattctccggttctaaatccggctccacgggcacattaaccatcactggggtccaagccgaggacgaggctgtctatttctgtgggaatgcagacagcagcagtactgataccacagtgactcagatgtaatacacaaacctcccggcagtgcaaggagcagataatacccttaactgtctgtcttacaggttccacctccatcaataccccatgctgcagggctcaggtcctcttaggctgccaggctgcaccctgctggctccctccccactaccctacacccaccctttgcagtgtcccctgcatgcactggggcaacacttcctcacctgtccgctccctgctggagggccacagccacctggttgatacatcagcatagcaccagttcttccccaagctggccctcccttggactctctactgagccccattttctcccctctcctctccaggttccctggtgcaggcagcactgactcagccagcctcagtgtcagcaaacctaggagaaactcaggatcacctgctctgggggtggcagtaacaatgcttatggctggttccagcagaaggcacctggcagtgcccctctcactgtgatctactggaatgacaagagaccctcaaacatcccttcacgattctccggttccaagtccggctccacagccacattaaccatcactggggtccgagccgaggacgaggctgtctattactgtgggagtgcagacagcagtggtgctggtcccatggtgacacacagcagtgaggaagcgatgcacaaacctcctgacagtgcaaggagcagccggcaggttttgctgtctctgtttgatggtggcacaggacctcaccacagccctaccttcactgtcctgcaatatgggtggctgtgcacggtgtcctgaacacgtcccaacaagatgcacagcactgcatcaggcccagcccctgcctgtagcagctgatgcccttgtccagcttctgcctgagctgcctctgtgctgggatgctccatgctgagctctgatcctccaaagtgcccatagctgtggctgggatcccttctgctctgatggtggtggcacattgcaggaacagagcccagaccagaacagctcagtacagagccagctccagcagggagagaatggggctgccagcagcaatgtggaacagctggggatggcacagagctgtgccttttcagggacaggtacagtgtgactcagtacccagagtaacctctcatacaactacatataccaaggaaggcatttacaagcatggccatgcagagaagatataaatcatcctcagtctcacagacctgctcagccataaggcatcaagggtgaaaaacctctatttttttttaaccctgatcaatccatcagttcctcacctcccgctgaggcaataccagcataagtgctgctgtcgtagccaccacagaaatagacagcctcgtcctcggcttggaccccagtgatggttaatgtggctgtggagccggatttggaaccggagaatcgtgaagggatgtccgagggtctgttgttgttgttatagatcacagtgacaggggcactgccaggagacttctgctggaaccagccgtagctgccactacccccggagcaggtgatcttgacggttcctcccaggtttgctgacaccgaggccggctgagtcagtgctgcctgcaccagggaacctggagagggagagaaaacagggctctgtgtgtgtctgacacgcacagcctccttgtttggcagtggggtgaggctgctgagcacacagacacacatgggacagcaggagacccacatctgctccaggattgacatctatggctggtaccagcagaagatacctggcaatgccccatcactgggatccatgctaacactggtagacccacaggcgttctcttaccattctctggggtccaatccaggcctacacacatgaactgtcacactaactaccactgtggtctaagctgtggagaacactgcccattactgcggtggcaatgacaggagccaaggcctgaggatggcacttatcaccaggatagcaggacaaggggttcacaagaaaaaaagaaaggttcttttttcctctcccgcttcctctcagtccagctctgtggtctcttctccttcctactgctctccttcaccctgtacatcagatcccagggcttcgctgcatttctgctcctgcaggcattgcctggggccctgtggcaagaccagggatcagtcagtccgggagtagcaatgagtatggctggttccaggagaaacctggtagtggtgctgtgactgtgatccacagtgacaccaacggaccctcgaacatcccttcacaattctcctgttccccatctggctccacgcacgagctaaccatcactggggtccaagctgaggacaaggctgtatattaccgtggagactgaagagcagcagtgatgctgtattttgacaatgtgtagtaggaacataaacacagccacattcacagtaaagttttcaggccaccttccttggtccccgagctttgggaattgtgacttatgttactgttttgggaattcaggaggccttgtcctatctgaatggccaagaccttgactgttaccccagatcatattccaggaatgagggtgatactgggtatagaccccatcatccttgtccctctccaggttccctggtgcaggcagcgctgactcagccggcctcggtgtcagcaaacccaggagaaaccgtcaagatcacctgctccgggggtggcagctatgctggaagttactattatggctggtaccagcagaagtctcctggcagtgcccctgtcactgtgatctatgacaacaccaacagaccctcgaacatcccttcacgattctccggttccccatccggctccacaaacacattaaccatcactggggtccaagtcgaggacgaggctatctatttctgtgggagctacgaaggcagcactagtgctgtatggtgacaatgattaaaaggaactgaattaataaattataagcctgttttctgcccatcttccttttggccatgcagaactgtggccatagcagtttcctgttccatctgcatggccatgctatgaatgcactcccttccacaccgcagggcacaggagatgtctgaagcacagggatgtgctgctgtgctctggacacctctcatcagaagtggccatagctgtgtccctttcttccatgtggggcatccactatccctgctattgccagcactcccagcaagacccctgccagtgccttctgctccttctaaccacagcagtgggtgctgcccccagagctgctcctctggatgctgtgccccacatttcctgaacacacactgcccatccagcaatgtgggacagggaacaccacagcaggaagagacctcaatcacagccatagtggaggcagacagaaacctgtcatttttagctctagacatcacatcactcccatatctccctgtgtctctgtacctacaaaactgctgtcataggccccactaggacaggaacatgaatggggctctgcaaaggcagcgccacagcagctgtggacccagagagcagaactgactgccctcaacagctccgcccatgcagggagatgtgcagcaacaaggaggggaggaaatccaacagtgccgccaccagcataaccagcactgctgtcgtagctcccacagaaatagacagcctcgtcgtcggcttggaccccagtgatggttaatgtgtttgtggagccggatgtggaaccggagaatcgtgaagggatgttcgagggtctcttgctgctttcatagatcacagtgacaagggcactgccaggagacttctgctggtaccagccatagtagctgctgctaccacccccggagcaggtgatcttgacggtttctcctgggtttgctgacaccgaggccggctgagtcactgctgcctgcaccagggaacctggagagggagaggagagaaaatggggctcagtgcctgacacacactgccctcctcctcctcctcatggggaggagaccccagagcacacaagcacacacagaatattcaaacaccgacttctaatccatgcttaacagcaactatgactggtacaagcagaagactcctgacaataccactggcactttgtaatacctccacaataagcccccctctctcctctccctctccaggttccctggtgcaggcagcactgactcagccggcctcggtgtcagcaaacctgggaggaaccgtcaagatcacctgctccgggggtggcagcagctatggttacagctggcaccagcagaagtctcctggcagtgcccctgtcactgtgatctatagcaacgacaagagaccctcggacatcccttcacgattctccggttccgcatccggctccacagccacattaaccatcactggggtccaagtcgaggacgaggctgtctattactgtgcgaacttcgacagcagcagtactgctgttagtgacgggggggagatgtgaaactctctacagccctgaattaaaacatggatgttttctgcctttctccctcaggatcacgctgggctctgtcactcaggcaggttcccctctgcatggccacggctttgaacatctttcctgttctgcctcattgtataggactctcccagtacctggaaacaccaaaaagatcatgtgctgcaggggtagcagcagctatggttatggctaatagcagatgacacctggcagtgccccatcactgtgatctacagtaacaccaagagatccttcatgattctctggttccatatcccacgccacacacacacacactatcactggggcccatgccaaggatgaggctgcctattactgtgtaaatgcagacaacagttgtacagtactgcttcccactgacacagagcagcaggtacaactgatgcactaacctcctgccagtgcagggagcagctggctctttttgctggctctgtttgatggcggtgctggttcctaccatggcccttccctcattgccctggactacatgtggcagggcaaaaatcacatccccagcactgacagcagggaacctgtggaccgctgagcagccaggccaaagctccctacttagaggggatgtttcccatggcacaaggctgggctggctgtgtttctcttctggcacgagggcagccacagaatctttcagatcaggatgattgttgtgatctgctcctacctcagctcaactggcatcacctacagcacagtgcccaggcctgtgtgcaggtggctgtcagagatctccaaggaggagactccatgatctctccgggcagcctggatcagtgctacattacctgcggagtaaggatgtgactcctgactctggccagacagaacctctgcgttcagtctgtgccactgcctcctgtactggtgctgaatgctgctggaaaaagcctggctctgttcactttgcaccctcctttcaggttagcgtaagggagaggagagaaaatagggctcagcaattgcccaacatgcacagccctcaccaggctgtcagatgaggcacgcaattccacaaggacacatggggtagcaggatacccacatctgctccaggattgttaacaactacggctggttccagcagaagtcacctggcagtgctcctgtcactgtgatctatggtagcaccagtagaccctcaaacatcccttcacgattctccggttccgagtccggctccacagccacattaaccatcactggggtccgagccgaggacgaggctgtctattactgtgggagtgcagacagcagtggtgctggtcccatggtgacacacagcagtgaggaagtgatgcacaaacctcctgtccgtgcaaggagcagctggcaggttttgctgtctctgtttgatggtggcacaggaccccaccacagccctaccttcactgacctgcaacatgggtggctgtgcacggtgtcctgaacacgtcccaacaagatgcacagcactgcatcaggcccagcccctgcctgtagcagctgatgcccttgtccaacttctgccagagctgcctctgtgctgggatgctccatgctgagctctgatcctccaaagtgcccatagctgtggctgggatcccttctgctctgatggtggttgcacattgcaggaacagagcccagaccagaacatcttagtaaggaggcagctccagcagcagcagaacggggctgccagcagcagggaatgatgctgtgccacagtaggaacagggaccaagaggatcacttcccacgcaataaagtataaaagagagggcattcaaaaacacagccatgcagagcagagagaaacctgactcagccccacagtcctgctcagccttaagtcagcaagtgcagaaaacctccatttcaactcaggtctgtaactcagttccacatcctcttttgtctctataccagcattagtgctgctatcccagccaccacagcctcatcttctgaccttagtgacaactaaccacaattggtcttccagggcccagggaaatagctgcactgggacaggagctgccagtgaccatgaggttctgcatgagtgggctgtgttgtgggcagttcagggtataaagaaaggagttggagtccatggcatagacccattggcataaggatgtgcatctgctgggatcacaccatggcctgtgcccctctcctgctggcagtgctgacccacagctcaggtgccccaggaacacccgttgtgcccagcctttgggcactgggccccatccccctgcttttttaagacttggcatcaattcaccacaacacctctctgcagcaccataccaacatagctgctgtccctgctcccacagaaatagacagcctcgtcctcggcttggaccccagtgatggttaatgtgcccatggagccggatttggaaccggagaatcgtgaagggatgtccgagggtctcttgtcgttgtaatagatcacagtgacaggggcactgccaggtgacttctgctgataccagccatagctgccactactcccggagcaggtgatcttgacggttcctcccaggtttgctgacactgaggccggctgagtcactgctgcctgcaccagggaacctggagaaggagagaagagaaaatgggctcaacaagagcctgacacacacagccctcccaagcagcagtgggatggggaacagcaccattaaaggaaaagggacttcagccatagccacatcaaaggatgagagcccagcccagagcagcccagcacagaggcagctccatggagcagggctggggatgacaagatgctgtatctttacaaggataggtacagtgtgggtaagtgtcagagtaatctctcatacatctaggtacagacaggagggcatttacaaacacggccacgcagagaggacagaaacctgcctcagccccacagcgctgataagccattactcagtaagtgcagaaagtttccatttttaactcaggcctgttactcagttttccatctccctgtgtcactgatccccaacttggactccagtgaaggctaaccatgatcagccttctgtgagctgagaaaaggagtgtagtgagcagggagagcactgcaataggagctgatagtgatcacacaggcctgtactatgggcagatgggagtttaagagtgaattgcggtccatggcatatgcctgtcagcatagggatgctggaggaattgcaccttggcatgagcccctctcctcctggtgatgcttgcccacagctctgacgtcctgggaaggctcactgcaccttgttgtcagtgaaactgcaataagctatcaagatttgatataattctgcccctctgatctacttgtgagaccacacctggagtactgcatccagttctggtaccaccaacacaaaaaggacatggagctgctggagcagggccagaggagggccatgaagatgaacagagggctgaagcacctcccctatggggacaggctgagagacatggggcttttgagactggagaagagaaggctccatgggacctttcagtgtccttccaatacttgaaagggtccttgaggaaagctggggagggacttcctataaggacatatagcaacaggacaaaaggaaagggttttaaactggaagaaagtagatttagtctagatagtaacaagaaattctttacagtaaggatcacgagacactgaaacaggttgcccaaagcagctgtggatgccccctccctggaagtgttccaggccaggctggatggggctttgagcaacctgttctagtgagaggtgaccctgcctacagcaggggagttgaacctagatggtcttaaaggtcccttccaacccaaatcattctatggcaattctatagagaacacctatgctgagagtagctacaagtatggctggttcctggcagtgcccctgtctctgtgatctatagcagcaccaacagaccctcaaacatcccttcacgattctccggttccaaatctggctccacacacacattaaccatcactggggtccaagccgatgacgaggctgtctattactgtgggagcacagacagcagctatgttggtatcacagtgacatggagcaattaaaaatgatgcataaccttttgcacatctgtaatgctataaggtgagagaaagtaagcaataatagcagagcagcacaatcctaggctacagcaaatgagaacaagcccagatgcagccacagaaataaagaaaaaaaaactgcttacctttagaaagcctcatatagacagggatctccagcaagatacccacacctccactgccaacccttaaatgagggctgggatgggctggatcctggctccacccctttcaatcactcaggtacattgcacacacctgagctcccctggctggccctgccttcccaccaggtgctcaatcactgctttgggctgtgactcagcatctccactacagcatcacagggagcggttgtcggtctctgctgttcctatgtgggtgccccgggacacctgaaggcatgagtggcagtgagggctcccagctctatccatggtgaacagacattatgtttatgctttacagcagcatgaatctggcagtggtgttattgctgtgatgctgctgtctatgctcccacagtaatagatagcctcgtcctcggcttggaccccagtgatggttaatgtgtttgtggagccggatccagaaccggagaatcgtgaagggatgtccgagggtctgttattgccattatagatcacagtgacaggggcactgccaggcatagtcgctgtaacccccggagcaggtgatctcgacggttcctcccaggtttgctgacaccgaggccggctgagtcagcgctgcctgcaccagggaacctggagagggagaggagagaggggagaaaatggatctgagcaattgcctgacacacacagccctccccagactgtgggatgaggccctgtgcccgcagtcacatgtggaatatcaagacacacacatctatgacaatcacaatctgattatcaaccactatggctggtaccagcagaaggcacctagcagtgcccctgtcactctgatctactatgatgatgagagaccctcgaacatcccttcacgattctccggttccaaatccggctccacacacacattaaccatcactggggtccaagccgacgacgaggctgtctattactgtgggaatgaagacagcagcggtactggtgccccagtgacacagagcaatggagatatgatacacagacctgacatctcagggagcagctggtcattatcctggtgacacaagtcccaggcatggcccagcactgtgctgcaggtggctatgccgggtgccctgctctgccctcctgtagagcctcaggactgtgcccatcactcagggaggagatggtcccagcagccttgtccctgccctgcactgcacttagctcctggaccccatctcctgctgcccacccatattgcctccctgtgttgctgttgcagggttgcttctgcctcatactggtttctcccttctggaggtggccaaaagccgggccctgtgcaatcctggtgcataaataccttatggcccctaagtagggcaggtgtgggacacgctctggcacctggggtgtgtgcaagtgctcaggaagacctgcaggcacaggtggcagtggggggtctctggctgtgctcgagcagcagctgcctggggtaagggtagtactctgtgcatgaacaatgctgcagggctcagctctgctcagaccacgaccctggcaccaacagagacctgcctggctctgtggtcatgtaaacctttacaggagctcaagacaaggctgtttattactgctctggcaggaaagaagcactggccatggtcatagagagttccagcaacaggaaagtgagagcccaagctgctgaggtaccagggctcctcaggtgcctgctgcagcagcttggacacagtcgaggaacagcaattgtacctgtgtggtggatcaggctgtgctgcctgtgaacctattctagcacatctgtcacctctgtgccactcacagggataccacccctgagacccctaccccatcagcctctgtgtgggatatggtgttgggcccaagggctctgttgcacagggagatagaggcctggggaggagggaaagcattgaggtggtgttgataccagggatgtgagcccaagcaagagatcagcagagcaaggaggaagaattgcaggtgttggggctggggaaagccccagatggctggagctggtggggccactggagatctcctcctcccatcctgctccatgctggggcagctgctgcaggctgaccagggcctgcccgggcacgttgtgaaggtcaccaaggatggagacttcagagctatctgggacacgtgttttaacgtttgatcagccttgcagcaaaacagtgttttgctctattgaacagtgttcaacaaaaacgatcagtggcctggaacacatctcctacgaagaaaggttgcgagagctgggtctggagaagagaaggctctggggcaacctccctgtggcctgtcagtgcttaaaggaggctcaagagaaagatggagagagactttatacacggagctgtagcaatatgacaaggagaaatggtttaaaatggaaagagggtagatttaggttagctatcaagaagaaattcttcactcagaggtgatgaagcactgtagcaggttgcccagagaagtattggatgcttccttcctggcagggcccaaggccagactggatgggttctgggcagcctgttctggtgggagatgtccctgcctgtggcatggcttggaaatgggtagcctttgaggtccctctcagcccaaatcattctatgttcttgtggttccctgcatttcagcctttgcctgttgactctggtgccactgttggacaattctactcagctgcgtttcatccctgccccaaagcagtaatcccatggataagcaatgctctgaggccttcaccaccctcagggctcctgctgaccctagcggcctccctggcagcatgagccctttgttgtccgcactgctgctgctgagggtcctgccagccccccagggccttttctgcccaggcactgccacctgctaaaacccagcctgcccatggcagggcatcgcatgtctgagggatggaacggggcaagggcagtgctgcaggcagtggttcaagaaacgtttagatgttgtactgagggatgtggtttagtgggaaatactggtgataggtggatggttggactggaggatcttagaggtcttttccaaccttggtgattatgtgattctatgaagggagccatagcctgctcccatcatgccccgccagtccggctctcccgagcactttggttccgcagcatccaggcccgctctggggccggtgtgggcctgggtgctgccacgtgtccccgctgcaaggcctggccaaccccgctgtgccacaatgcaggggctgggctaggagtgggcagggaggtgtggggagaggcgtaggacgtggctgggagcgcagggagttatttgcataggggggcgtgctgcggaaggacgcgggtataaaagggcatcgaggtccccggcacagccccatcggcgtggggacacacagctgctgggattccgccatggcctgggctcctctcctcctggcggtgctcgcccacacctcaggtactcgttgcgcccggtcggggactgtgggcacggggctctgtcccattgctgcgcgggcagggctgtgcgtgcggggccgtcactgattgccgttttctcccctctctcctctccctctccaggttccctggtgcaggcagcgctgactcagccgtcctcggtgtcagcgaacccgggagaaaccgtcaagatcacctgctccggggataggagctactatggctggtaccagcagaaggcacctggcagtgcccctgtcactctgatctatgacaacaccaacagaccctcgaacatcccttcacgattctccggttccaaatccggctccacagccacattaaccatcactggggtccaagccgacgacgaggctgtctattactgtgggagtgcagacagcagcagtactgctgcacggtgacacaaagcaatggggaaatgatacaaaaacctcctgccagtgcaaggagcagctgatggtttttactgtctctgtcttacaagtcccacctccattcctgccctgtgctgcagggcccaggtcctcctgcattcccaggctgcaccccaggtccagctggctgcctccctgccatccaacatccaccatttgtagtgtcccctgcatgcaccaggctggcagctcctcatctgctcctgctcccactgagaccacctgcccagcccatgctggagggccaccaccactcaattgcactgcacatcagcacagcaccagttctcttacatgtgtccctctgaggaaaagagctggacttctaagcacccttagtgtactcacctaaaatgaaactgaaaccccataaaagtctcagaaatacccagaaactgttcatccatagtatatggcatcaactttagctatatacttttcatagatagtttcaatgagtttctatcacttgcaccggtcacttgcacctaagccttcccagaggaaaaccaaacctttgaaacagaaagtacttccaaccacaaaatctttgatgcatcattcattttctagtgactcaggagattcaccaactctgcctctttctataaccacttgcacaaaccacagcatttgcatatttgtgagtttatttttaagccagtgccttggctctggcagctctggttgggcatcaacatcctcttcacattttcttttcctctcttgaggaggatgtgggcagcatgtgcagcgcagtggtgcaccaatgggataaagctgggcccagtgacctcgaaggacaacatcagcgagagtaaggccatcaaaacagacaggcctgaattggaggggctgcactaaaactggatgacaggcaagaacattatttggtgggttcttgtggcaggttgacatgacattggccaagaccttgaccaacaatggcacagctactggatatcccttggaagaggtgaggaggacacacagacaccatctacactctgtgacccacagcaggcagcagggctcagccacacatgagcgggcatgggccgctgcttgggctgtttctgcacggccatgtatcactgcaggtatttccccggtgggacctcaggaatcaactgatcgtcctcaggaagtcgctctgtgttcacttacagtcctccccagcagtaagtgggtgctcaggctcctcacagcctttttttttttttttggttggttttgttttctttgtccaactttggctgtggcagtacatccttggtctgcctaaccacactgaaatgtactcatgcacctttccctgatttgcagaaagaaggttgtatggtctgaatgctctgtgctgttgcaagtctcttctggttcttcgaaatctgcagagtccctcccgactgtgtccttggtactgaacatccttgttcaccgtgtcagaaggcagctggggggctggaggcagtagtgcgtggcaccaggatcccctggggcatttcttgcctgcggcgcctgggtgctccacgtggctgccagggggacacacctcctgtagcagcccccagcaccaccatcctgctgtgtccattccgtcaccttgatcctactgtgtccagcccatcgtctcccttctgctttgcctgtcagaagaacacttccatcccatcacttctgacccaccccctcatcctgccgcctccacaggacccagaactgcccctgccacgaagtgggaggtttttgcattgctccgtatcactgtgtggtatatttggggccgggacaaccctgaccgtcctaggtgagtcgctgacctcgtctcggtctttcttcccccatcgtgaaattgtgacattttgtcgatttttggtgatttgggggtttttcttggacttggcggcaggctggggtctgccaccggcgcagggccgggcactcagcgcggcagcctgggctgagtcttgtccccaccgagccggagggctccggtgtgcgccatggaggacttagggttattttgtcaatggaaagttcttaaaatttgaccagaaaatgtgcccgaggtctgtctctgccacacgatttcagaaattgtgtctaggtcgatgagaagacagtttttgtctttgtcaggaaattagttgtgagttgttagtccttccctcttagtcctaaggactaagacctttgtccccggtctggtctctcactggggactcttggctccagtgccatggggagcccaagtgtcactgacacggtgtccttgggggtgaaattcagtttttcagctgtccaggtaagtgctgtcaaaaaatggaggttattctgctgaaaaagctgagaggaatattttgtcatttttttcggaaatatatatatatatatatatataaatatataaattatttatatattttatatatatatatatataaaatatatgtatttctctctttctttttatatatatatataaatatatatatatttctccctctttctttatatatatttatagggagagaatctatatttttggccaatttggccaatttctctctctctctctttatatatatatatatatatatatgtaatttatatatatatatataaatttatatttatttatttatttatttatatagattatttttatatacatatatatatataaatttggccaatttagaagaaattggccaaaaaaacccaatctgaaccaaattacttagggcataagtccaaaaaaaaagtgcagttcaagaattcctcgctggaaagtttttaatgggggcagttcttccccattttctggtgtagatatgagtgaagatatagatatgtatgtagatatagatttggctatagtttgtttgatgaacagtctgaggaagagtaaatcttgccttcctcatggcaatttttaattctacttcttctgagacaagtctgaacatgccttgaggtagaaagagcccgaaaattgagtgctttttctttgaaattttaattaaaattaaaaaatagccttacagcaggaaagaaagggggtgatggcagctaatcggagttccaaagctgaaccacgttcacccaaacacgtggttgaaattttgtgtgtgtatatatataaatatatatatgtatacaaaagaaaatgcctatatataaaaaaattgttatgtatattatatagatttattatagatatgtacataagatataacacgtatacatatatatgtagtctgctgtatgctttgtataaatttttatagatatgatgtatattatatgcatgggttatatatctataatatattttatctgtagaaggaactacagtataaaatgcatatatgcgtatatatacacatatttatatatatgtgtatatatatgtatacgcacacgtataacatccatgaaaatagatatggatgggtggatgtgtttgttttacagaggtgcatgtgtgtctgtacatacacagccatacatacgcgtgtggccgctctgcctctctcttgcaggccagcccaaggtggcccccaccatcaccctcttcccaccgtcaaaggaggagctgaacgaagccaccaaggccaccctggtgtgcctgataaacgacttctaccccagcccagtgactgtggattgggtgatcgatggctccacccgctctggcgagaccacagcaccacagcggcagagcaacagccagtatatggccagcagctacctgtcactgtctgccagcgactggtcaagccacgagacctacacctgcagggtcacacacaacggcacctctatcacgaagaccctgaagaggtccgagtgctaatagtcccactggggatgcaatgtgaggacagtggttcctcaccctccctgtccctctgggccgctgctggtggcagcagccctcacttcccactcagatgtcccccaccgtgcccccatcacccacctctgcctgtcgactcctcttgccctcatctctccaggtgtcacattaataaacacgacactgaactagtgctgactctgcatccatgtctctgtgtccttttgcgtgctgtctgcatctcacacaggggggtcggccccagtatggggaagggctggggggcgcatacacacatattggtaatgttggggacgggggggggggggtgggggggtcaacagatcagcactggagacactggtgtataccctggcaccaccaacatctaaggcagggtgctttggggcaattttggggcagtttaaggtctgtgctggcactgagcacgtggctgtggccgtgctgtcctcatctcccacccactacggtctgtgcgccaggtccctagcagagatttgctttatgctgggaacagggggagttctggctctgttcccttgcattcagacaccctggtgccccctgggtgggatgtcagtgtgaatactcctttgtgccctgtgcctgcagcagcctgaccctccacacaccacacgccttgtgtgcaccccacccctgtcactatccctctccccgctccccagggagattttgcagtggcccctgtagggcagcttttagcacagcccccagcagcaagcaagcagaaagcactgctgtgcacagcttgtcagctgtgtgtgtttgctgaggaggatctgtcttttgctgaggccatcagtcttgtcctgctcaacctccatcgatgctgcccacctcaacacatctacccatctattccatctacaccaacatctccattcatcccacccacccaaacatgtccatccatcacaacacctccatccaacccgcacactccagcacctccaatcattccatctacaccaccatgctgatctgctacagccactccaacgcaaccgtccattccatctacaccaatgtccatccatcccagccactccagcacctccagccatcccacccaccctatgtctccatccagccactggtggggtgcaggacatggggccagctctactgtcaggactggggtttttgcatggccccataccacttctgcagaagagacgcactgaaagtttggctgaccattttctccacggtagagttgtggcagttctgtaatttagggtcttttatccagtttggagatgggctgggatctcccagctccatggcaggcattcatgacactgggtttagtatctgatgggtgggatgtggctgaacttcattttctttccccagtgacaaagtttttgcagttgaatatgaattcctgctttctgctctatgagttgtttttttcccaggacgtacacagggaatcagcagtcttcattctccctctgccatgtgtagactctctgccacacaggactgtgctgtcctcatgcccctgcgcccaaattgctgccctctgcccatgcctgccaagctgagccctgcaggctgccatgctggattgacatgagccctgagattggtacagaaatggtgattttggggttttctttgcactcaggaagctgaaggctcaatgctcagtgatggatttaccaaactgtgccctgaggcagctgctcatgctggataaagtcactggagcacagggaaccaggcgctgggcagggatttctcatgggccccacttggaaagctgcaggctgcaaacctggctctgccttcacgcctcaccctcatgaggacaacctcactaattattgattaaaagattttgctaaaccatctccagaagcaacaacccactgaggagcatgtgctgaattatacatcacagctccacggccctgccctcatagcagggctgcatggcacccacagtggcactcagagggaccacagggctgagacagccgggtctggtggtggggacacagctgagcataggatgagccccccgggcagtgctgggctttgctaatgagcagaagtatggatagaaagcaaccccagggctccgtacccagctgcagctcttgctctgtcgtgtcctttggtgaaactttaaacagtcgcctttttttttctctttcttttctggcttgccattaatttcaaaccgagagagacctaatttagtaaatgagatgcttcaggaaggctttaattagctgcagatggaggcaggcagtgctatcgtggggcctggatcgcacagggggctgcatatcctcactagcagaatacactcaggctgggtccctcccacattcatgccccagaccagagggaatatgctctgttccccacacatcgctcccaatcttgcagccgttgagccccaacatcccaccagcacacggggctcagcacgcctggcgacatggcatcagcagagcaggccgcatggtacagctccatcagcacagctggggccacacaaagagctgggttactgtgggcagcaggctgaaacccgaaaacaagagctgggggctcagaatagccccgggagcaggcagggcctgggggtgagggcaagcaccaggcccagggccacacagcccttccaggaaggcacagcgctgtcagggtgcagcacgctcagccccaccatgcagctgtgcggccggggcatccccaagctaaatttacttctcagtctccaatcagaaactgaagctgaggggcccacaccggccaaaaaaaggaaacgaaacagtctccagaaagcactgacgtgtgaagcagagcgagcgccgcgcaaaccggccgccatgtcacacacctcaggttggggctttgccagactgagctttgctgctgctcggggtgggtgcccacggcctgggcacatgggatggggtacacacgtacacacacttgcacacccacaccccaacacttcaggtgatgctggtgcagatgggtgccccccaggctgacccccccacgcatgggcctggccccacactgctccatccgtgtctctgtccccatgtgccacccctgcccgctcccaccacgcgtcaccccaaatcctgagttaatcccacgactcctgcctgcttccagcgtccatggcagactggagatgcccaaaatgcagagcaggtttccctgaatctgagagatgaaatggagttatgggtgttcccctgcggcggagccccagctgtaggaagctcagagccatcacacagcaattaaagaggaattaaattaaatcaataaatgttttaggcgggctcagctgccagcaccacctgaccgaaacagcccgcttgcaaagaggagagcatttgcatggctgtggcaaaacagcaaccgcctgttgtgcagctgggatggtgttatctggaaatgtacgcagcccaggaggggtaaacagctccaaactgagaccccgaacttgtccacaggttgtaaacaggctgacataaacacctttgtgccgtggaaaaatatttatcacctcaaatatagcaggttaataaaataaaactcccaacggagctacacacctgctttggaagggaagcagacacttgttttctgcttgatgttggctgtaggaagccatgtttcccgatgcaggagggccacaaagcactgacaacacaatgtgagctgagcttcgcccctgtttaagcccccacctcagggcttgtggtctcggagcaggcaggacgcaggggtggcaccgggctgggtgacatgggctggtcctggggtgtctcactgagctctttggggaggggttggagccctggggcaatcacagcacacacagaggaggtggggggatgcagccagcagctgccctgcactaagaaaaccccatccgtgggctttcagatggccttcccatctctctgcagcctctgcatgggctgaacacaaggtttaagtgtttctgccatgtttttggggcatgtttggaggggcagcgtgggcccgggcatacgggtactgccacgtgccgccagccccacagctgagcctgcactctcccagatgtgctgaccgcagccacgggggcaacagtttctcttgctaaaaattgtagccgggaagaaaacacgtggcaacttcggccaaacagcagctggaggacaggaatagccgtggccacggcacgctctgcttcctcggcacaaacattccagtacgtggcaccacgagcgccgctgcccggcacagcagcaagcagagccaggagcaggaaatgctgatttgggccccattttggccatggctgagagaagaggcttccagggagctggtcagcttggtccccaagctgtggcttggggaaatgatggggaggggattgccactgcccaccctgcagagcaggctctggtcccatctcactgcagggcaccagggcgtttgcactgcagcaattcacagaaacattgaaatggctcctgccttgttcaacatcttcatcagtgacctggatgaggggacagcatccaccatcagcgggttcactgatcatatgaagtcgggaggagtggctgacgcaccacaaggctgtgctgccattcaacaggacgtggacagactggagagctggacagggaggaacccaatgaggttcaacaatggcaagtgtaggatctacacctgggaaggaataacagcatgcatcagttcaggttaggggctgagctgctgcagatgagctctgagagaaggacctgagcatcctgctggacagcaggctggctgtgagccaccggtgtgccctggtggccaagaaggccagtggtatcctggggagcaccgcaatgagagtgggcagcagggcgagggaggtgaggctgcatttggagcaccgtgcccagttctgggctcctcagttcaaggcagacagggaactgctggagagagcccagcagaggggctgcaatgatgatgaaggtcctggagcatcgcctgtatgaggaaaggctgagggacctgggattgttcagcttggagaagagaagactacagggcaggagccaagtggatagggccgggctctttccagcagtgcccagtgacaggacaaggggcagcaggcacaaagtggaacataagaagttccatctgaacatgaggaaaaactgcctcgctttgagggtgtctgagcactggaagaagctgcccagagaggtggtggagtctcctctggagatattcagagcctggcaggacactttttgctgagtaacctactgtagggaacctgacgcagcagaggggtcggactggaggatctccggaggtctctttcaacccctacagttccatgaaatacctcaaacactgccaagcgcagtgctaaggcaagggtaacatttgtaaactgaaacagggtgggtttaagttagatgtaaagaagaaactcttcactcagagggtggcgaggccctggcacaggctgcccatggaggctgcgggtgccccatccctggcagtgcccaaggcaagagcccagcagtgaccacagccccacaaggacgagcgtggcccctcgtatctcagctcaccctgccccagctcaactcccacctccggcacagcgcgggcacacagccgggccctgtgcttatggagcccttggggcaggtcagcactcacaccctccaaacacagccgtggctcccaaccggaggcagctggatctcggcagccataaccaagcagggccatgcgggggtgacaccggggtcccccaccccctgtggggcagcgtatgggctgggcccctgctccagtctgcagcgtgtgcatgggaaccatcaccagacaccatctagaccacctgcagccctaagctgcctcacagcagggattgctccgtcacaccgtgaccccgtgcccttattccatcacttacggggctgggagtgcctggaccttgggcacattaacgaggatttcccgctctgccctcgctttgctccgagccgtggggctgtgtagtgcagacacagctgcagcctaaaattagcacctgggaaaggcccccatgctgcaccgcgcagggctgagatgtgccacgtccccatggccggagctggggaaggcaacgtggccctgtgcgtgtgcacgctgagcacaaggacacgtgctgggccaggatttgtctccccggggctcacgctatgtgtcaccccgtgctgtgccatcccctcccgcagcccccagctcccccacggccgcacgccgcctgcatccctgcaacggcaccgcacagagacacggagccaggggccgcacacggggccaggagctcacctttattgcagccctgacagccccacggcccagcccatagcggggctgccacatcctcacccggccgacggccccagctgctccttaccatttcttcccccatcacccataaaccagaagccgcctcaccgctacgcggagcgggcagcagggaacccgggccctaagggggagacgagagggggccgagcaggggcaggaggagcagcagggcgagggggcagcgggggcacccacagctggccgtggcatcccgggaggagaagaccttgcggctgcggagcggttgtggcggacggaaattgttggtcatcttcaggggcgcagcgcccgaggccgggaagtgcacggtgctgacaaacgcctgcagctgcggggagagcaccgcgggcgccgcagccgtgaggcgtagggcgaagcggggcacacgcgtggctgctgccgggcagagcgcagcgcaggagccccgtctttccccctaccggcagcacacggctctgcacacaccgcgcttcgtgccgcctcgcagccgacgctgcaggaagcccagccgagcgcttacagagcggccgggaaatgcatctgctgaggtgcccgggcaatgcagaacttcatccatccccacatccattcaccagtcccctcccaaacccccatgcccatccggcgacccacccaccctcctcttggtgcccctctcaagctctccatccccacattcctacagatgtcccctttactttgcctgcaaggtgcaagaaaacgcacagggaccgggggtgctcacagcacggctttggccagacgggcccttccatcccatggcagcagggccgaggaatcccattacctgctccctgctgatgcccacaggctcctcaaacacggtccagatgacggcctcgctgcagtcaggggttgtcagggagccctggtagcggtagtaccgggacagctgtgcaacgtgcggcagcagcgtgccaaggcggaaggtggaggccaggtccactgcctgccctgcacagcaggacatgggcactcagccccgctgcccctggcacgccccagggtctctcccctcccagccgtgccccattgcagagcaccagggcacctcaccagcatgggagatgttcctcagtcccccaatgatggtgttgtagttggagtttggggcttctgagacctgcaaagagcgagtgggccctgcagctgtgctcatttaaggccaacgcatggcagcacccatcccatgcactttgcagccaacctggaagaagcagcccagcacagccagcccgcttgggtgccccttggcctcccccagggtgcggtacttgacgttgatgtggacgatgtgcagctggagaaagaaagcacggagggctcagcagaggcacccggcctcgccagcagccaggcaccaggatgggaaatcaaagggccgtggtgctaaggggcttcttgcctacctccatggggagctgctgcccatccacggtgtgctcagagccattcgtagacaggctgccccagtggaagtgcagctgcagtgcacggtagcggcccgggaggcccccgccactgatggcaatgtgctcagcacccggctcgctctccaggctcagcatcactgcaaacgataggagtgggacaggactgggggccgtggggcagcactgctgcagagctgagccctggctggagcagaacacccacccgtgtgcccatcgttcagcagccgccacttgccggggggtgcctggtcatagccctcaaagatgatgtccccaaggctgccgtcccgctgcagccagcgccggtcgatgttaaccggagactgcttgtcaccgccgcaggtggccttcagctccttccagtggctggggcctgcggggagcacggccatgggggcacccgcagagccaccagcaccacccccaggggggacacagagccaagggcagccctgtccccaccacggaccctgccccatctccagcccttctctccccgttactccaggaaggttttacttggaaacctgtggagctgtaacccgccccgtgagctccccattacccaccgccttcattaagggatggtgccctcagcacgtgcctgttctgtgctgccccaaccgccccccgccagccccagcacggtttaattgctgctggagccggctctgtgccgggcagtgaggctctgagcgctgctggacgcagctgacctgcagcacagtgagcacgcacctgagggctataaagcaattgggctgtaactgctgattacatgctccctgatccttaattaacctcttacaagctattatacgtgcgtttccaaagtgcccccgggcactggggagggaggcaccgaacagagctgtgaccgtccccactcaccgcacttcgggtcctgcgagtcgtagcaccactgccctgcgggagagagctgtagtcaggggctgcagaggcccccaaagcccccccatactgcggatctctgcacagcacacagcgtgaccgtgggcagaggtgcgcccacaccgcccggagcagcgctacgcggagccgcttccctcccacctcgctgctgtcagtgcagggacacacagctctgctgtgttgggagcggggtgaggagcgcggctgctgcccacggccgctctgctccgctcatgtcccaccaacccatccaaatccccgtgtgggaactcagccaccccagcactccctgcctacagggatggttccccgctgaccccgtgctctctccagccacaggccgcaggcagcgctgcgtgcaccgcctgtgctgctggcttcgcatccatgtcctcaccacgctgctatgtgaggctgcagccacagggctgggaacagggactgtcccagggcagtgacttcaggctttccttcccatccagcgggaactgagcctcctgcacaccctcagagccacaaagcgctgccctcacccaactgtgagcatccctggcgtgagccaggtgggcgctctgctctatagaagggtgctgcgcactccagccccatttgctctgaggtgtcgtcctcagtggcatttccctgcttatgagtacatggggcagaggggctgaaacctcaatcccagctgcctgattgaccgtccgacatcccagacacctcccagcagggctgacacctccctgagcccggcagcacggcggggacaggggtgtcccacggggagggcacagaacacagctcctgggctgcaccacatctccgagcgccacagacatgcattccccccaacatgtgggaaagggaatagagtgctggcactgccgtacccccctcccggcaccatgctaccccataacccccaagccacctgcactccgtgcccatccctccgcagccccaaccacgacggtgcagcagacgggcagcgcat

SEQ ID NO: 187 - DNA, 12233 bp, Artificial Sequence
  Humanized light chain locus
gcgatcgcataacttcgtataatgtatgctatacgaagttatagaggatcctattaattgtttgttaattaagaggacaggaattcagtgtcagggggctgctctttgcttcccaatgtgtaccactgaagcctctctggatttatcagagatactcaatggactcttaacagcactgtggcacctgacctcctgctgccttcagcctcccttcctggctggtgtgcttgtgttgaggagctgtgggaggctggtgcagttctgtgggatgaggtaaggccagctgaatagcctgggggctggtcagggggcttagtgagaggagcagggctggggaatattgtgaacagcaggtggtgccactgctattctgaggaaggaggcagcttctgcaaatgctttgcaatgcaggatgacaaagtgcttctgctagctctaggcccttgctcatggctgtgatggtgcttaacggtgccagagtgcagtgccagatatgacatgcagatgacccagtctccatcctcgctgtcttcctgtctaggtgagagtcaccatcacatgccaggaaagtcaggcagggcattagccatgttttagcctgatacaaagagaagccagggaaagcttctgagctcctgatctacgatgcatccaatttgcaaacctgggtcccattgcagttatgtggcattggatccaggacagatttgattctcaccattagcatcctccagtctgaagttgctgcaacttcttattattggtcaacagtataaaagtgaccctctgtacacttttggccaggggaccaagctggagatcaaactaccagcagaagacctctggcagtgcatctgtcgctgtgctgaaaccaacagacacaccaacaccacaggacagcttcttgcagttctccatctcctggtgcagcttcatgagcacgttaaccatcgtggggattcaagctgaggatgtagctgtctatccctgtggcaacagggacagcagtggtaagcctggtgaggtgatacagggagatgtcaaaaaaaaagaaaaacccaacatgtatggggttaaaaatggaggctctctgcccttttctctcatggctgagctgggctgtgcagtgaggtaagttcctgtctcgtctgcaaagcactgtctgaatggtctccctattgtgtgttgtggtgcatgagggattctggggacagagggcatttgtctgtccctataaaggcccaaagcccctggctgtgtacagtaagtccgcctggggcacctgagctgtgggcaggtactgccaggagaggggctcaggccatgatccaataccaatggctctgtgtccccatgctaatagggctatgctgcagcccatcactccctcttaaaccccctcttaaacttcctacagttctaagttctatctctctcctccaattaatcatcgtcaccatagtttgatatccactttggtcccagggccgaaagtgaacggaggggcattgtaagtccgttgaccgtaataagttgcaacatcttcaggctgcaggctgctgatagtgagagtgaaatctgtcccagatccactgccactgaaccgagatgggactccagattgcaaattggatgcactatagatcaggagcttaggaactttccctggtttctgccgataccaatttaaataactgctaatgccctgactcacccggcaagtgatggtgactctgtctcctacagatgcagacagggaggatggagactgggtcaactggatgtcacatctggcacgaggagagaggggagaaaatggagctcagtgagtgtgcgacacacacagccctcagcgtactgcggtgggataatacttctgagcacacagtcccaaatggaacctcaggactctctcatctgcttcaggatgaacaatgtgtgccagatgtgacatccagatgacccagtctccatccttcctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttattactgtcagtgtggttacagtacacctccgactttcggccctgggaccaaagtggatatcaaacaggcagcagtaatcctggtttggtgatacagggagatgtgcctccccccaaaaaaaccccaaacaaacaaaaagcatatatagggggtaaaaatggagtttttctgcccatctgtctcacagccaagctgggctgtgcagctgcggcaggttcctggcctctctgcaaagctctgtttgtgaatggccttccttcctcttgtaccttgtggtgcaggaggagattgtggggacagaagccacttctccttgtccctacaaaggcacagcactgtgtcatccccagccctcctccatgttactgctggcagtcccgtcctcctgcttctgaagagacatggatgtaggtgaggtctcttctgcaacagtggtgttcatcaccccacagctgccaggtgagggctgtgtgtgtcggacatttggctgagctccattttctctcctgtccctctccaggtgccagatgtgccatccagttgacccagtctccatcctccctgtctgcatctgtaggagacagagtcaccatcacttgccgggcaagtcagggcattagcagtgctttagcctgatatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaataattaccctcacacgttcggccaagggaccaaggtggaaatcaaacagtgctgcctgcaccagggaactgggagaggagaggggggagaaaatggagttcattgagtccctgatatacggagtccttgctaggcaatgagataagacagctgagcccacagaccatcttttacggaccagaagtgacatccagtcacccagtctccatccacactgtctgcatctgtaaggagacagtgtcaccatcacttgccgggcgagtcagagcattggtagtaatttagactggtatcagcagaaaccagggaaggcccctaagggcctgatctatgctgcatccagtttgcaatctggggctccttcgcggttcggtggcagtggatctgggacagattttactctcaccatcagaatcctgcagcctaaagatgttgcaacttattactgtcaacagtataaaaattaccctatgacgttcggccaagggaccaaggtggaaatcaaacactgtgatctatgctgacaccaacagacccaccaacaccacggggcagcttctcacaatcctacacgttctggtgcagcttcatgagcacattagccattgtggggactcaagctgaggatgtggctgtctatttctgtggcagcagggacagcagaggtaagcctggtgaggtgatacagggagatgtcaaaaaaaaatgaaacaacatgtataggagttaaaaatggaggttttctgctctcttctctcacaggtgagctgggctgtgcagtgagatgagttcctgtcccctctgcaaagcactgtctgaatggtctccctgctgtgtgttgtggtgcatgaggagagtctgaagacagagggtacttctccctgtccctgagaagctgctgcatggtgtcatccccagccctgctgcatgttacactgtctgccctgtccttctgatgccgaagctgcttccatgctgggatgctctgggctgagctctgattctccaaaatggcagtggtttcttctgatggtggtggtattcctcattctactgctgtgcagggagggctgtgtgtgtgttggctacccactgagccctgttttctctcctctccctctccagggaccagaagtgacatccagtcacccagtctccatccacactgtctgcatctgtaaggagacagcgtcaccatcacttgccgggcgagtcagagcattggtagtaatttagactggtatcagcagaaaccagggaaggcccctaagggcctgatctatgctgcatccagtttgcaatctggggctccttcgcggttcggtggcagtggatctgggacagattttactctcaccatcagaatcctgcagcctaaagatgttgcaagttattactgtcaacagtataaaaattaccctatcactttcggccctgggaccaaagtggatatcaaaccagtgaggggcattgaggctgggaacaatgcagtgctgtgcctttgcaggaacagggataacggggcactggacccagaattgattactgaatgaaaaggttcagtaagagaggacatgcgtgtgatgtacagtctggcagaagggactggattctccctcagccctgactcaacaagggcagaaagccttggttttgaatcgcagtctgcatgtcacccccacatctccccacatcactatacgtttgatctccagcttggtcccctggctaaaatggggaggggtactataatactgttgacagtaataagttgcaaaatcttcaggctgcaggctgctgatggtgagagtgtaatccgtcccagatccactgccgctgaaccttgatgggaccccactttgcaaactggatgcataatagatgaagagcttaggggcttttgctggtttttgctgataccaggctaaataactgctaatgccctgactggcccagcaagtgatggtgactctgtctcctacagatgcagacagggagaatggagactgggtcatccggatggcacatctggcacactttgggacctgagccagactgtacctgtccctacaaaggtacagcactatgtcatccccagccttgcttcatgttgctgctgcaagccctgttctcctgctggagctgtctctgtgctgggatgctctggtctggactctcatcttctaatgtgccggtggccatgactgaggtttcttctcctttaatagtggtgctccctttcccactgttgtacgcagagggctgtccatgtggggtattccctgagccccactttctctcctctccctctccaggtgtcagatttgacatccagatgatccagtctccatctttcctgtctgcatctgtaggagacagagtcagtatcatttgctgggcaagtgagggcattagcagtaatttagcctggtatctgcagaaaccagggaaatcccctaagctcttcctctatgatgcaaaagatttgcaccctggggtctcatcgaggttcagtggcaggggatctgggacggatttcactctcaccatcatcagcctgaagcctgaagattttgcagcttattactgtaaacaggacttcagttaccctccccattttagccaggggaccaagctggagatcaaactagtgccagggggagatgaggcggtgaattgatggccagagctgaaaatgatgggtttccacccttctccattatgacttttgttgagatctcttctcatgatggtcttccctggttttcctgtggttggaaggagcagaaggcactggcaggggtcttgctgggagagctggcaatagcagggatagtggatgccccacatggaagaaagggacacagctatggccacttctgatgagaggtgtccagagcacagcagcacatccctgtgcttcagacatctcctgtgccctggggtgtggaagggaatgcattcatagcatggccaggtggaggtaagagtaacatgcctactgcagtaattctgcacatagagaaggaagaaagacagaaaatcttcctacagttctaagtttcctctctcttctccaattaatcatcatcaccatagtttgatatccactttggtcccagggccgaaagtctgagggtaattattaaactgttgacagtaataagttgcaaaatcttcaggctgcaggctgctgatggtgagagtgaaatctgtcccagatccactgccgctgaaccttgatgggaccccactttccaaactggaggcatcatagatcaggagcttaggagctttccctggtttctgctgataccaggctaaagcactgctaatgccctgacttgcccggcaagtgatggtgactctgtctcctacagatgcagacagggaggatggagactgggtcaactggatggcacatctggcacctggagagggagaggagagaggggagaaaatggagctcagtgaatgtgtgacacacagccttcagcatgctgcagtgggactgagcaccagcacttgctcagctccattttctccaggtgccagatgtgacatccagatgacccagtctccatcctcactgtctgcatctgtaggagacagagtcaccatcacttgtcgggcgagtcagggtattagcagctggttagcctggtatcagcagaaaccagagaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtataatagttaccctcccacttttggccaggggaccaagttggagatcaaaccacagtgacacagagcaatggagatgtgatacacaaacctgtcagtgcagggaacagttggcactggcactcatctactcctggactcacaagtgccagatgtaacatccagatgacccagtctccatctgccatgtctgcatctgtaggagacagagtcaccatcacttgtcgggcgaggcagggcattagcaattatttagcctggtttcagcagaaaccagggaaagtccctaagcacctgatctatgctgcatccagtttgcaaagtggggtcccatcaaggttcagcggcagtggatctgggacagaattcactctcacaatcagcagcctgcagcctgaagattttgcaacttattactgtctacagcataatagttaccctcccactttcggcggagggaccaaggtggagatcaaaccactgatgctggtagtgacggggagatgtgaaactgaggtacagccctgaattaaaaacgtctgttttctgcctttctcccttatgtttgttctgggctgtgtcactgaggcagttttccctctgcatggccatggctttgatcatcttttctgtcctgcctcagtgtttggaaggtgactctcccagttaccgcggaggaaccatgaagatcatttgctcctggtgtagcagtagctatggttgtggctgcatctggcttcaacagcaagttaaccattactcatgttgaaaccaaggatgaggctgtctaagatgtgtgagctagcatagcagtgaggctggtagagtgacaaagggaagcatagctgtgatgtctacttctggagtgcactggggcatgaaagcgaaaacagtcaaagccacaaccacacggagggaacaggaacatgtctacagccataactctgcgtggccaaaatgctgaaagtcagaaaaccagcagggagcggggctgggtgcagtgcatgccaaccctttgtggggacagctgtagaacatggaattcaatctcagtggagtcgaaccaattggcaggctgtcagcagaggcattccccagtgctcccctttgtttaatgtgaaattacaaacaacgctgccaggcaacaaactgtattgatctgcttgagggtaggaaggccttgtagacagatgaggataggcaaaaatcaatgggctgtgtcaaacccattgacgttcaagaacgttaagtcccagggcctgcacttaggtcataacaacacaaggcagcagtgtaggctgaagagatggttgattagagggttctgttagaatggttcaattctgtgatcatgaagataacttccaaacaaaattggtgtaggatagggataaggtgctctggccccagaatcacctgcaacaaaaaatacagcagggagggcataaacaattgcggccctgcagaggggcagggcatctgcctcagtttgatctccaccttggtcccctggccgaacgccggagggtaactataatactgttgacagtaataagttgcaaaatcttcagactgcaggcagctgatggtgagagtgaaatctgtcccagatccactgccgctgaaccttgatgggaccccactttgcaaagtggatgcagcatagatcaggagcttaggggctttccctggtttttgctgataccaggctaaataactgctaataccctgactcgcccgacaagtgatggtgactctgtctcctgtagatgcagagaatgaggatggagactgggtcatccggatggcacatctggcacctggagggggagaggagagaaaatggagctcagtaagtgcctgacacgcaacacccagtgccagaagatagcactgatccccaagacaaggagaccatgcatgccaaagaggttcctctttctctcccacttcctctcagtccggctctagggtctcccctccttcctcctgctctccttcaccctgtacatcagatcccagggctttgctgcatttctgctcctgcaggcattgcctggggccctgtggcaagaccagttccagatgcgacatccagatgacccagtctccatcttctgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcactatcagcagcctgcagcctgaagattttgcaacttactattgtcaacaggctaacagtttccctcccactttcggccctgggaccagggtggacatcaagcccgcagtgccaccaccagcatatcgtttgatatctactttggtcccagggccgaaagtgagagggtcacttttatactgttgaccaataataagaagttgcagcaacttcagactggaggatgctaatggtgagaatcaaatctgtcctggatccaatgccacataactgcaatgggacccaggtttgcaaattggatgcatcgtagatcaggagctcagaagctttccctggcttctctttgtatcaggctaaaacatggctaatgccctacctgactttcctggcatgtgatggtgactctcacctagacaggaagacagcgaggatggagactgggtcatctgcatgtcatatctggcacctggagagggagaggagagaggggagaaaacggcaatcagtggctgcctgacatacacagcttccccccgcaaagcagcaggacagaggccccatgcccatacaggcccaggtcacctgaactgttggtgaccatcactagtaggagaggggcccagaccatggtgctactccaacagttgtgctatggaccccaactcccttttagacccccacccttctacagcacagccacctcctgcaagcctggtgtccatggatactggccacccccatcccatgctccccttgcctcctgtagccattttccttgatctcagaagaccaatcatggttagccattactgggatccaaaatgagcacaagactatctactactgcggtagcttgggaaacagcactgatactggtagaatggcacagggagatgggaaactgagttacaaacctgagttcaaaatggaagctttctgcacttactgcattatggctggacagggctgcaggggctgagtcctgtttctgtcctctctgcacggccctgactgtaaatggcctcctctctcttcttaaccacaatgtacctgtccctgcccaggcacagcactacgtcaaccctagccctgctccatgttgctgctgtgagctcctatctccttctagagctgcctttgtgctgagatgctctgtgctgggctcttgcccacaaacatacctatgtctgtgactgaggacccttctcctctgatggtagtgcttcccctgcggttggggagggcagggcaaattgggcacctgttgagccccatttactcccctctccctatgcaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcctgatctatgctgcatccagtttacaaagtggggtcccatcaaggttcagcggcagtggatctggcacagatttcactctcaccatcagcagcctgcagcctgaagattttgcaacttattactgtctacaagattacaattaccctccaacgtccggccaagggaccaaggtggaaatcaaacgtatggtgatagggggcgatgtggggggaaaaaaaaaaaaaaaaaagacacatataggggataaaaatggaggttttctgcccatctgtctcacagccaagctgggctgtgcagctgaggcaggttcctggcccctctgcaaagcactcgttgtgaatggtctccctcttgtacagtgcagtgcaggaagagataccaggtatgtccagacctgtttgctgttactgctggcagacctatcctcctgctttgaagaggcatggatgtctgtgaggcctcatctgccagggtggtgttcctcatcccacccctgccaggtgagggctgtgcgtgtcaggcaaacactgagccccattttctcccctctccctctccagataccagatgtgacatccagatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttgcaacttattactgtcaaaagtataacagtgcccctctcactttcggcggagggaccaaggtggtgatcagtcccacagtgactcagatgtaatacacaaacctcccggcagtgcaaggagcagataatacccttaactgtctgtcttacaggttccacctccatcaataccccatgctgcagggctcaggtcctcttaggctgccaggctgcaccctgctggctccctccccactaccctacacccaccctttgcagtgtcccctgcatgcactggggcaacacttcctcacctgtccgctccctgctggagggccacagccacctggttgatacatcagcatagcaccagttcttccccaagctggccctcccttggactctctactgagccccattttctcccctctcctctccaggtgccagatgtgccatccagttgacccagtctccatcctccctgtctgcatctgtaggagacagagtcaccatcacttgccgggcaagtcagggcattagcagtgctttagcctggtatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaatagttaccctcacaccttcggccaagggacacgactggagattaaacccatggtgacacacagcagtgaggaagcgatgcacaaacctcctgacagtgcaaggagcagccggc

SEQ ID NO: 188 - DNA, 13281 bp, Artificial Sequence
  Humanized light chain locus
gccggcaggttttgctgtctctgtttgatggtggcacaggacctcaccacagccctaccttcactgtcctgcaatatgggtggctgtgcacggtgtcctgaacacgtcccaacaagatgcacagcactgcatcaggcccagcccctgcctgtagcagctgatgcccttgtccagcttctgcctgagctgcctctgtgctgggatgctccatgctgagctctgatcctccaaagtgcccatagctgtggctgggatcccttctgctctgatggtggtggcacattgcaggaacagagcccagaccagaacagctcagtacagagccagctccagcagggagagaatggggctgccagcagcaatgtggaacagctggggatggcacagagctgtgccttttcagggacaggtacagtgtgactcagtacccagagtaacctctcatacaactacatataccaaggaaggcatttacaagcatggccatgcagagaagatataaatcatcctcagtctcacagacctgctcagccataaggcatcaagggtgaaaaacctctatttttttttaaccctgatcaatccatcagttcctcacctcccgctgaggcaatacggttggcgtccaccctggtcccttggccgaacgtcggatggctgctgtaagtctatagacagcaataagttataacatcttcaggttgcaggctcctgatggtgagaatgtgtgaaatgtgtcccagacctactgccactgaaccgtgacgggaccccagattgcaaactggatgcagcatagatcaggagcttaggaggattctctagtttctactgatactagcttaaataattgcaaatgccctgactcgcccagcaagtgatggtgactctctctcctacagatgcagtcagggaggatggagactgagtcatctggaaattacatctgactcctggagagggagagaaaacagggctctgtgtgtgtctgacacgcacagcctccttgtttggcagtggggtgaggctgctgagcacacagacacacatgggacagcaggagacccacatctgctccaggattgacatctatggctggtaccagcagaagatacctggcaatgccccatcactgggatccatgctaacactggtagacccacaggcgttctcttaccattctctggggtccaatccaggcctacacacatgaactgtcacactaactaccactgtggtctaagctgtggagaacactgcccattactgcggtggcaatgacaggagccaaggcctgaggatggcacttatcaccaggatagcaggacaaggggttcacaagaaaaaaagaaaggttcttttttcctctcccgcttcctctcagtccagctctgtggtctcttctccttcctactgctctccttcaccctgtacatcagatcccagggcttcgctgcatttctgctcctgcaggcattgcctggggccctgtggcaagaccagtgccagatgtgacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtataatagttaccctctcactttcggcggagggaccaaggtggagattaaagtattttgacaatgtgtagtaggaacataaacacagccacattcacagtaaagttttcaggccaccttccttggtccccgagctttgggaattgtgacttatgttactgttttgggaattcaggaggccttgtcctatctgaatggccaagaccttgactgttaccccagatcatattccaggaatgagggtgatactgggtatagaccccatcatccttgtccctctccaggagtcagatgtgatttccagatgactcagtctccatcctccctgactgcatctgtaggagagagagtcaccatcacttgctgggcgagtcagggcatttgcaattatttaagctagtatcagtagaaactagagaatcctcctaagctcctgatctatgctgcatccagtttgcaatctggggtcccgtcacggttcagtggcagtaggtctgggacacatttcacacattctcaccatcaggagcctgcaacctgaagatgttataacttattactgtctatagacttacagcagccatcccacttttggccaggggaccaagctggagatcaaactatggtgacaatgattaaaaggaactgaattaataaattataagcctgttttctgcccatcttccttttggccatgcagaactgtggccatagcagtttcctgttccatctgcatggccatgctatgaatgcactcccttccacaccgcagggcacaggagatgtctgaagcacagggatgtgctgctgtgctctggacacctctcatcagaagtggccatagctgtgtccctttcttccatgtggggcatccactatccctgctattgccagcactcccagcaagacccctgccagtgccttctgctccttctaaccacagcagtgggtgctgcccccagagctgctcctctggatgctgtgccccacatttcctgaacacacactgcccatccagcaatgtgggacagggaacaccacagcaggaagagacctcaatcacagccatagtggaggcagacagaaacctgtcatttttagctctagacatcacatcactcccatatctccctgtgtctctgtacctacaaaactgctgtcataggccccactaggacaggaacatgaatggggctctgcaaaggcagcgccacagcagctgtggacccagagagcagaactgactgccctcaacagctccgcccatgcagggagatgtgcagcaacaaggaggggaggaaatccaacagtgccgccaccagtttgagatcgaccttggtccctccgccaaaagtgagagggtaactattatgctgtagacagtaataagttgcaaaatcttcaggctgcaggctgctgattgtgagagtgaattctgtcccagatccactgccgctgaaccttgatgggaccccactttgcaaactggatgcagcatagatcaggcgcttaggggctttccctggtttctgctgataccagcctaaatcatttctaatgccctgacttgcccggcaagtgatggtgactctgtctcctacagatgcagacagggaggatggagactgggtcatctggatgtcacacctggcacctggagagggagaggagagaaaatggggctcagtgcctgacacacactgccctcctcctcctcctcatggggaggagaccccagagcacacaagcacacacagaatattcaaacaccgacttctaatccatgcttaacagcaactatgactggtacaagcagaagactcctgacaataccactggcactttgtaatacctccacaataagcccccctctctcctctccctctccaggtgccagatgtgacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccctctcactttcggcggcgggaccaaggtggatctcaaacttagtgacgggggggagatgtgaaactctctacagccctgaattaaaacatggatgttttctgcctttctccctcaggatcacgctgggctctgtcactcaggcaggttcccctctgcatggccacggctttgaacatctttcctgttctgcctcattgtataggactctcccagtacctggaaacaccaaaaataccagatgtgacatccagatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccgctttgcaatcagggggtcccatctcggttcagtggcagtggatctgggacagatttcactctcaccatcagcagcctgcagcctgaagatgttgcaacttattactgtcaaaagtataacagtgcccctcccacctttggccaggggaccaacctggagaccaggcaaatgcagacaacagttgtacagtactgcttcccactgacacagagcagcaggtacaactgatgcactaacctcctgccagtgcagggagcagctggctctttttgctggctctgtttgatggcggtgctggttcctaccatggcccttccctcattgccctggactacatgtggcagggcaaaaatcacatccccagcactgacagcagggaacctgtggaccgctgagcagccaggccaaagctccctacttagaggggatgtttcccatggcacaaggctgggctggctgtgtttctcttctggcacgagggcagccacagaatctttcagatcaggatgattgttgtgatctgctcctacctcagctcaactggcatcacctacagcacagtgcccaggcctgtgtgcaggtggctgtcagagatctccaaggaggagactccatgatctctccgggcagcctggatcagtgctacattacctgcggagtaaggatgtgactcctgactctggccagacagaacctctgcgttcagtctgtgccactgcctcctgtactggtgctgaatgctgctggaaaaagcctggctctgttcactttgcaccctcctttcaggttagcgtaagggagaggagagaaaatagggctcagcaattgcccaacatgcacagccctcaccaggctgtcagatgaggcacgcaattccacaaggacacatggggtagcaggataccgttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctctcactttcggcggcgggaccagggtcgatctccgaccatggtgacacacagcagtgaggaagtgatgcacaaacctcctgtccgtgcaaggagcagctggcaggttttgctgtctctgtttgatggtggcacaggaccccaccacagccctaccttcactgacctgcaacatgggtggctgtgcacggtgtcctgaacacgtcccaacaagatgcacagcactgcatcaggcccagcccctgcctgtagcagctgatgcccttgtccaacttctgccagagctgcctctgtgctgggatgctccatgctgagctctgatcctccaaagtgcccatagctgtggctgggatcccttctgctctgatggtggttgcacattgcaggaacagagcccagaccagaacatcttagtaaggaggcagctccagcagcagcagaacggggctgccagcagcagggaatgatgctgtgccacagtaggaacagggaccaagaggatcacttcccacgcaataaagtataaaagagagggcattcaaaaacacagccatgcagagcagagagaaacctgactcagccccacagtcctgctcagccttaagtcagcaagtgcagaaaacctccatttcaactcaggtctgtaactcagttccacatcctcttttgtctctataccagcattagtgctgctatcccagccaccacagcctcatcttctgaccttagtgacaactaaccacaattggtcttccagggcccagggaaatagctgcactgggacaggagctgccagtgaccatgaggttctgcatgagtgggctgtgttgtgggcagttcagggtataaagaaaggagttggagtccatggcatagacccattggcataaggatgtgcatctgctgggatcacaccatggcctgtgcccctctcctgctggcagtgctgacccacagctcaggtgccccaggaacacccgttgtgcccagcctttgggcactgggccccatccccctgcttttttaagacttggcatcaattcaccacaacacctctctgcagcaccagtttgatgtccagcttggtccccgggccaaaagactccggagggtaactattaagctgttgacagtaataagttgcaaaatcttcaggctgcaggctgctgattgtgagagtgaattctgtcccagatccactgccgctgaaccttgatgggaccccactttgcaaagtggatgcagcatagatcaggagcttaggggctttccctggtttttgctgataccaggctaaataactgctaatgccctgactggcccggcaagtgatggtgactctgtctcctacagatgcagacaggaaggatggagactgggtcaactggatgtcacatctggcacctggagaaggagagaagagaaaatgggctcaacaagagcctgacacacacagccctcccaagcagcagtgggatggggaacagcaccattaaaggaaaagggacttcagccatagccacatcaaaggatgagagcccagcccagagcagcccagcacagaggcagctccatggagcagggctggggatgacaagatgctgtatctttacaaggataggtacagtgtgggtaagtgtcagagtaatctctcatacatctaggtacagacaggagggcatttacaaacacggccacgcagagaggacagaaacctgcctcagccccacagcgctgataagccattactcagtaagtgcagaaagtttccatttttaactcaggcctgttactcagttttccatctccctgtgtcactgatccccaacttggactccagtgaaggctaaccatgatcagccttctgtgagctgagaaaaggagtgtagtgagcagggagagcactgcaataggagctgatagtgatcacacaggcctgtactatgggcagatgggagtttaagagtgaattgcggtccatggcatatgcctgtcagcatagggatgctggaggaattgcaccttggcatgagcccctctcctcctggtgatgcttgcccacagctctgacgtcctgggaaggctcactgcaccttgttgtcagtgaaactgcaataagctatcaagatttgatataattctgcccctctgatctacttgtgagaccacacctggagtactgcatccagttctggtaccaccaacacaaaaaggacatggagctgctggagcagggccagaggagggccatgaagatgaacagagggctgaagcacctcccctatggggacaggctgagagacatggggcttttgagactggagaagagaaggctccatgggacctttcagtgtccttccaatacttgaaagggtccttgaggaaagctggggagggacttcctataaggacatatagcaacaggacaaaaggaaagggttttaaactggaagaaagtagatttagtctagatagtaacaagaaattctttacagtaaggatcacgagacactgaaacaggttgcccaaagcagctgtggatgccccctccctggaagtgttccaggccaggctggatggggctttgagcaacctgttctagtgagaggtgaccctgcctacagcaggggagttgaacctagatggtcttaaaggtcccttccaacccaaatcattctatggcaattctatagagaacacctatgctgagagtagctacaagtatggctggttgtgccagatgtgtcatctggatgacccagtctccatccttactctctgcatctacaggagacagagtcaccatcagttgtcggatgagtcagggcattagcagttatttagcctggtatcagcaaaaaccagggaaagcccctgagctcctgatctatgctgcatccactttgcaaagtggggtcccatcaaggttcagtggcagtggatctgggacagatttcactctcaccatcagttgcctgcagtctgaagattttgcaacttattactgtcaacagtattatagtttccctccgactttcggccctgggaccaaagtggatatcgaactcacagtgacatggagcaattaaaaatgatgcataaccttttgcacatctgtaatgctataaggtgagagaaagtaagcaataatagcagagcagcacaatcctaggctacagcaaatgagaacaagcccagatgcagccacagaaataaagaaaaaaaaactgcttacctttagaaagcctcatatagacagggatctccagcaagatacccacacctccactgccaacccttaaatgagggctgggatgggctggatcctggctccacccctttcaatcactcaggtacattgcacacacctgagctcccctggctggccctgccttcccaccaggtgctcaatcactgctttgggctgtgactcagcatctccactacagcatcacagggagcggttgtcggtctctgctgttcctatgtgggtgccccgggacacctgaaggcatgagtggcagtgagggctcccagctctatccatggtgaatttgagatccaccttggtcccaccgccgaaagtgagagaataactattatactgttggcagtaataagttgcaaaatcatcaggctgcaggctgctgatggtgagagtgaattctgtcccagatccactgccgctgaaccttgatgggaccccactttccaaactggaggcatcatagatcaggagcttaggggctttccctggtttctgctgataccaggccaaccagctactaatactctgactggcccggcaagtgatggtgactctgtctcctacagatgcagacagggtggaaggagactgggtcatctggatgtcacatttggcacctggagagggagaggagagaggggagaaaatggatctgagcaattgcctgacacacacagccctccccagactgtgggatgaggccctgtgcccgcagtcacatgtggaatatcaagacacacacatctatgacaatcacaatctgattatcaaccggaccagaagtgacatccagtcacccagtctccatccacactgtctgcatctgtaaggagacagcgtcaccatcacttgccgggcgagtcagagcattggtagtaatttagactggtatcagcagaaaccagggaaggcccctaagggcctgatctatgctgcatccagtttgcaatctggggctccttcgcggttcggtggcagtggatctgggacagattttactctcaccatcagaatcctgcagcctaaagatgttgcaacttattactgtcaacagtataaaaattaccctatcaccttcggccaggggacacgactggagattaaacagctgctcctcctgggccccatctgctgagagtgattctcagagcagccaggcttgaaggtcctgcaggttttgttggaaggggccagggtgactcctctgaggccccctcctttcctcctccttggcggcagcagtacacactttgggtaaccttccgtgtctgctgagatgcagtcagataggagaattctctgatccctcaccacctgcacacaggggcagtgtccccaggtgtccacatcagacccaggttgcacaggtctcctacagagaatgtctctctggggtctcagcagagagaggaccagtgtgtgtagaggtccacgctctcctcacggctcagcccagctttgctgctgctgctccacctgtgacaggggctgcagggcttgcacagcccagaacctggagaagctgagcagctcctcagtgtggttctggtggacgtcactgaggccagggcggcttctgctttctcttatttcctaatggcctttgtaacataaaagagcaataaatagaaaacatagtgagggctatgatttataaaactggctgtgcttggatcctgccacacactgggagtcctacatggagttttgtgctctggactgtggcctgacccagcctcagctgacaggctcatccgggaaactaccagcacgtggaggattttctctctctctctttctctctctcactttgtctttcaccaatgctcagtctttcaagtaaataaataaataaatatttttaaaaatgggaaatattacatttaataaaataaatggggggcacatgtgcaatcgtgtcagttttcaatctgatggagtagttcttgattcaatgcaaaatcaagtagaacattctcatccaattgcactaatagcagcttcactgttggcacataaaggcacacaaagaatagtagcacaaattcttaggcctgaaataattggaagaagtcgaacagagccctttatgtcatagatctttcattttagtgggccgggcagatgagaaacaaaccaatgacgttccaactgtgctcccactgtgtccatgtgatgtgcctcccatggagcagggccagtgctcaggacaatggggctgtgggtgtgcaggtgcatgtgtgcctccttctgtctccacctagacagggcagaggcagaggcagaggagagggaatgtatcgggcaactccacatctgtgtttcctgaaaaataaactcattgtactctcggtgatggtcgggtagacaaactgtcctgacaaaagattttaagatttctcatgtccctgtagcataaagtcagtcagcacacaggtcagagggaataatcagtgcccagacactggagataaaaaaaatggagcccagttttagtgcgcattagcagggaatgtgatcagaagtggagcagtgggcttcaatccagtgtctgatgtaggctgctggctttgcaagtggcaacttaatccatgtaccatgatgccagtctaccctcctctctagattttcttagagataaagtgaaggtttcaggagagaggagagaaggaagttatttttcttgatgtcttcagacctatggtgaggccttgaactttcacttttctttcctcctgcatccttgactcagaactctggctgcaggtgggagagcacacatgtgtgatctctcatctaagcacctgtgttatccttctgagtcctggtctctggcagccgcttgttctgaggatgtttattctgagtcagtacagaggtaagtgtgggtagaagtctcgtctctcagagacaatctccctggtgcagcggtctccatgaggggacaagatgagggatcaaaggacaaacaggtgaaagacatggacctcagctttaaggtgtaactaagtattccctagaaaagcatttctactaaagaattccaccataagcatgaacaaattacaccttcttgtcctccagttcaattatagggttggcaaatgtccctcagggaatttgggaggtgatgtctcctggtggaagcatgcgcactgcaggtaaacttgtgcagccctggtctgagctggggcagctggagacacagcccctggactgagttctgaactgccctgggcccttcagctgggcacagccctgccccgcccctgctcatttgcatgtccccagagcaccgcccacctctctgggcatttaggagcaggctgctcccgccccatgcaggaggcagtgccaggcaggacccagcatggacatgagggtccccgctcagctcctggggctcctgctactctggctccgaggtactcgttgcgcccggtcggggactgtgggcacggggctctgtcccattgctgcgcgggcagggctgtgcgtgcggggccgtcactgattgccgttttctcccctctctcctctccctctccaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggagggaccaaggtggagattaaaggtaagtggccgtttcactgattcctcaccgtttctgcctgattggtttgttttttccactttttcgctgtttgtgtgtctttgttggctggaggtcagggttctaacgaatttctttccaagatgaggcacagaggagggaaaactgtctgagatttccaagtcaaaataacttccccggggagagggcttgccgccttgtcagggagggttttgtggagggagaaggtaaagggagccaccgtgaagttcctattccgaagttcctattctctagaaagtataggaacttcccctttctgtccaactgtgaggtcttggtcccctggatcacctgggcaagtttgtgatgtttcagttaaatgagccattcctggcgaccccaaaagtaaatagaagaaaataatcaaaagcggagaagacagaaatttgggggtttgggagaataggagagaaacagcagaagtttctctacagttgccgtgtggtgggactggccgcaaagggaggtttttgtgaggggtgggatgacagagtgacttacttttggctcagggaggcgcgcc

SEQ ID NO: 189 - DNA, 6607 bp, Artificial Sequence
  Humanized heavy chain locus
ggcgcgccataacttcgtatagcatacattatacgaacggtaaggggagtgcggctccaccagggggcgcgcaagacacactgagtccagattctggtcctgctcaggcacagagggagatgaagccctggtttcctgtcagggatttgggtttcctctcctacagttttgagggaagacttctacttcaggattctgtcccttacactgacgccactgacgtagagaagctttatgtgacaggaagaagtcttaaatggacacattcaggtttgtgaacgatgacagtggtcaccagggtcagagatgtgagacaatcaggggacctcgtgagtgttgtccagtctgactcaggacagcgttccaggacactgccgactataagacaattttagttttccttcaaacccagacagacccgagccagagtcttgatttgctacctcagttttataagtcgtcccatcctcctgtcagagcagcctgtgtgctgcactgaaccaaccgtcttattttaactgtgggtgttctgcattcactttctacagactttatacccaatctccatttccctttaatcctgaaacagtctgtggtccctgtgtgcacttccagctgatctggttctgctccagtgtcgtgggaacccctgcacctgctgtggttcagggagagcagaaagtgggacacagagcggctgtgcactctggggctggagtccacatcacggggagctgtgtctgtggctccagcatgatgcccagtgtcctgaggctgaatcacagctgcaggaagagccagtcccagagaccatgtgtccagagtccctgctcttcactccatgtctatgctgactggggtcatcaatccatttgtgttctttcatcagtattagagagggagacacccaggctgcatatcacattgctggatggagcccatttgcacgctttcccatacttgtactgacagtgcaccctggaagacagtacatgatggatctgtatgaggccccatcaccaaggtgggaacactgatgcagtttcatgctcctgggttccagctgacaagcttgagtccactgcctttatttatcatctccataaaacatggccaacacaacaccagtattcaaagatcaatcgtcatgattggccatcgttgctatttcatattcctaaatgtttgataaataatattgagtatagctctatgaggtacaatgatatgtgtggacaaaatgaatgcatattgagtggaattatgaagtcaggcttgatgacacattcataccacaacacatgtttttggtggagttcacctgtctcctgctcttaagagatttccactcacaatattctcttaacctctgtcaccatgctgtgcagtagatccctcagtgtgtggagcctgtgggactaaaactctgaccttgctccagcgtctcctctgttcctccctcgctcagactttggtcttcaccattgtacttcctgcctctgtgccttcagccttttatcccatgtaggtagcatcacatattatgtgtcttcctggcctggatgcttagcagagtgtacttttactgacatattatcttaggcacattattctccgggatcatccaagttgtccaaaatcacagaatttcttactctgtactgcttttaaacttccttttaaaatgtaactttgtccatttctttcattttccattcttgcttccatgagatgtcactggatcatatgtgtgaactcttttgaatggcggtgctttaaatgaacaaggaactgcagaggtgtttgccacagtgactgcagatcccgtggacacctccctgggatttcatattcattgtaccatgcaatggtgcttgaagatcatgtaataattctgtttctagtttttgatgcttttccataatggttttactaattaacctgacacagacttgtaccagggttatcatctctctctacctccataaaacatgtcagctctggtatgtctgataatagtcattctaacaggagggatgggatgtctcattgtgcttctaacatggacatacatgatggtcctagatttgtagcattttatatgtttgtctttatatcttcttttgaaatttatagatgtaacataaattttaaaatttatcattttattggccagcgcatggctcactaggctaatcctccacctgcggtgactgcaacccagtttctagtctcggtcgggcgccggattctgtcccggttgcccctcttctaggccagctctctactgtggcccgggagtgcagtggaggatggcccaagagcttgtgccctgcaccccatgggagaccaggagaagcacctgactcctggcttcggatcagcgtggtgcaccggttacagcggccattggagggtgaaccaacggtaaaggaagacatttctctctgtctctctctctgtcactgtccactctgcttgtcaaaaaagtgtaccattttatttaaaaatttgtctttatatatttgtccaaaaccacagagagactgagactgacagtgatcttctaattcctggtcacttctcagatggctaccaaagattcagctgggtcaggcgacagccaggtgcttggaattctgtccagggctcccacgtgggactacttggaacttcacctatggcctcccagaggggcttaggaaggaatatgagactggaaccaaactaggacacagcactcagcatcctcatacaggagcaggaatccatcaggctcactccagtgctgctcctgtcaccaccttatcatcactgcatttaaggaattgatttcttcccttgggattcagttgtttgagatcttcaacattaggaaataggctttcaatcatatgtataattaatcttcaatttattttaagtatctattttattttagagacagtgttatagcaagagatgaagagaccaacagatggagagagaagcttctgtccagtggttcacttcgtgaatggctgcaaaggctatgatggctgagcctaaagccaggagcctggaacttcctccagtttcccacagggctggaaggggacaaacactttggtcatggtcgacagtgatcaccattgcaatgcctacatctgtgagttcaattgtggactgcatatacaaataatgtcacatactatgtgtccacatctacctggatcatttcttttagtatgtatgctccaggctgacccatgtttcctactgacagaacgacctccttcttaatactgaataatattccatgtccaaatgtgaaagaatccattcactgttctgtgaacacttgcttaattgtagactgaactattatgaacacagctgcattacctgaacccaggactgcgggtgaattgtgacacagtgacttctacccagtgcttgagctgaactcagagtcatgattacagaacagggaagagggggaacacagggcagctgataacaggacgcaaagcaccactcacaggaaggaataattctgcctacaccacagtgggctgactcagttcaccacaacccatgacaggttccacaaataactagaactgaggtctccaggcctcccaacagagtgatggaaaggaggtggaaatgtgcatgacactgagttcatctgtgcccatttctaccatgcacattccaatagcacacaaaccccactaccatgtacagtgttctgtgttcaggaacagttttaaactaaagcaatggatgaataaatgaacaacacatagttaaccttaaaaaatcaacttgcagtccttcatctatttaaaagtgggcagcaggcattaggacaaaattggctaagtccccactagggtcacccgtgttcccatcagagaactgactgagcccagcctcacggcttcccacacttttccctcataatgcatcatgggaaactgtagatgacactacaggcaaaggagcccctaccaccgacgttggaattacagacacagtttcttgcttcagggttcagaaagactaactcctaggggtcataggcatttgggatgtctagggctctcaacccaaaggcagaaatctcccattgtcaccttttctgtccatctctacatttctgtaactctcaccccttctatctctatctctgtcccaatgtctttcatatagatgataaggaactaatgggatttaaataaatgaggaacatgatattgctaacactggatattaagggtgcacacatattaaaatgaaacaaggtatctgccttcaactttttaaaataattataacataaaaattcatatgatctgaatcatatcacagccatcaccgtacacccccaggtcaccacatctgccctgggcgctgtcctgtctgaggcgtctgaccccatgcctgctatataggggcagctcatgcaaatggggcctccctgtgcccatgaaaaccagcccagccctcaccctgcagctctggcacaggagctccagccccaggactcccaggtgtccactcagtgatcgcactcaacacagacgctcaccatggagactgggctgcgctggcttctcctggtcgctgtgctcaaaggtaatgatggggaacgcgggacactgagtctgggagaggatgtgagtgagagacacagagagtgtgagtgacagtgtcctgaccatgtcgtctgtgtttgcaggtgtccagtgtgaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagacacagtgaggggccctcaggctgagcccagacacaaacctccctgcagggtcgcgcggctctaccagggggcgctcaagacgcactgagtgcagattctggtcctgcacaggcgcagaagatgaagccctggtctcctgtgagggaattggggtttcctctcctgtagcagttttgagggaagaattctactttttgattctgtccttcccaacttcactgacggagagaaagtttgatgtaaaaggaagaagtcctaattgaacaatttggttcatggacagcgactgtgctcaccagggtcagagatgtgggaatattgaggactctattgagtctcttccaacctgactcaggacagcaccctcagggcactgaaagctttggacagtttcagttttccctgtataaccagggacagctgagacagggtcgttgatctgttaaacagcaactattccactcatccctctcctgccacaaccagcaagtgtgcactaaaccaacctttgactctacatgtgggtgatccacactcactttctgcagactttaacccgacctgcatttccctttaatcctggaacagtctgtggtccttgtgtgaacgtcacagcactcaggaatgtactgcagctcagctgtgtctcaggctgagcttctgcaggcacctgggaagcctacagggacttcctcatcctctaggtcctgggaccctcctggggggctccctgcctgaactcaggagggaaatgccctggacatcagcagtcaaggtcatcactgaatggaaagtgttgggtgtgcacttccagctgatctggttctgtcaagtgtcgtggcacctcctgcacctgctgtggttcagggagagcagaaagtgggacacagagtggctgtgcactctggggctggagtccacatcacggggagctgtgtctgtggctccagcatgatgcccagtgtcctgaggctgaatcacagctgcaggaagagccagtcccagagaccatgtgtccagagtccctgctcttcactccatgtctatgctgactggggtcatggatccattcggagtctttcatcagttttagagagggagatagatacacaggctgcatatcagagttctggacagagcacatttacactatttctatacttgtaagtgaaaatgcaccctaaagacagcagatgatggaccagttatgaagccccatgaacaaggtgcaaacgctattgcagttccatgctcccgggttccagctgccaagcctcaaattaactggcatttatttatcatctacataaaacactgagaaacacaacaccagtattgagcgaactgaatctgtagttggccattttgtcattttattttcataaatgtttgataaataataattgaacatagacatgagataaatgatatgtgttcaaaaatgactgtatcaaattgatggaattatgaagtcattcttattgacatgctcatcacaaaatccacatgttcccatggtcgaatgtcagtggtctcctgttttggaattcaatagacccaatattcatacgcgt

SEQ ID NO: 190 - DNA, 15699 bp, Artificial Sequence
  Humanized heavy chain locus
ggcgcgccgcaacccagtttctagtctcggtcgggcgccggattctgtcccggttgcccctcttctaggccagctctctactgtggcccgggagtgcagtggaggatggcccaagagcttgtgccctgcaccccatgggagaccaggagaagcacctgactcctggcttcggatcagcgtggtgcaccggttacagcggccattggagggtgaaccaacggtaaaggaagacatttctctctgtctctctctctgtcactgtccactctgcttgtcaaaaaagtgtaccattttatttaaaaatttgtctttatatatttgtccaaaaccacagagagactgagactgacagtgatcttctaattcctggtcacttctcagatggctaccaaagattcagctgggtcaggcgacagccaggtgcttggaattctgtccagggctcccacgtgggactacttggaacttcacctatggcctcccagaggggcttaggaaggaatatgagactggaaccaaactaggacacagcactcagcatcctcatacaggagcaggaatccatcaggctcactccagtgctgctcctgtcaccaccttatcatcactgcatttaaggaattgatttcttcccttgggattcagttgtttgagatcttcaacattaggaaataggctttcaatcatatgtataattaatcttcaatttattttaagtatctattttattttagagacagtgttatagcaagagatgaagagaccaacagatggagagagaagcttctgtccagtggttcacttcgtgaatggctgcaaaggctatgatggctgagcctaaagccaggagcctggaacttcctccagtttcccacagggctggaaggggacaaacactttggtcatggtcgacagtgatcaccattgcaatgcctacatctgtgagttcaattgtggactgcatatacaaataatgtcacatactatgtgtccacatctacctggatcatttcttttagtatgtatgctccaggctgacccatgtttcctactgacagaacgacctccttcttaatactgaataatattccatgtccaaatgtgaaagaatccattcactgttctgtgaacacttgcttaattgtagactgaactattatgaacacagctgcattacctgaacccaggactgcgggtgaattgtgacacagtgacttctacccagtgcttgagctgaactcagagtcatgattacagaacagggaagagggggaacacagggcagctgataacaggacgcaaagcaccactcacaggaaggaataattctgcctacaccacagtgggctgactcagttcaccacaacccatgacaggttccacaaataactagaactgaggtctccaggcctcccaacagagtgatggaaaggaggtggaaatgtgcatgacactgagttcatctgtgcccatttctaccatgcacattccaatagcacacaaaccccactaccatgtacagtgttctgtgttcaggaacagttttaaactaaagcaatggatgaataaatgaacaacacatagttaaccttaaaaaatcaacttgcagtccttcatctatttaaaagtgggcagcaggcattaggacaaaattggctaagtccccactagggtcacccgtgttcccatcagagaactgactgagcccagcctcacggcttcccacacttttccctcataatgcatcatgggaaactgtagatgacactacaggcaaaggagcccctaccaccgacgttggaattacagacacagtttcttgcttcagggttcagaaagactaactcctaggggtcataggcatttgggatgtctagggctctcaacccaaaggcagaaatctcccattgtcaccttttctgtccatctctacatttctgtaactctcaccccttctatctctatctctgtcccaatgtctttcatatagatgataaggaactaatgggatttaaataaatgaggaacatgatattgctaacactggatattaagggtgcacacatattaaaatgaaacaaggtatctgccttcaactttttaaaataattataacataaaaattcatatgatctgaatcatatcacagccatcaccgtacacccccaggtcaccacatctgccctgggcgctgtcctgtctgaggcgtctgaccccatgcctgctatataggggcagctcatgcaaatggggcctccctgtgcccatgaaaaccagcccagccctcaccctgcagctctggcacaggagctccagccccaggactcccaggtgtccactcagtgatcgcactcaacacagacgctcaccatggagactgggctgcgctggcttctcctggtcgctgtgctcaaaggtaatgatggggaacgcgggacactgagtctgggagaggatgtgagtgagagacacagagagtgtgagtgacagtgtcctgaccatgtcgtctgtgtttgcaggtgtccagtgtgaggtgcagctggtggagtctgggggagccttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagacacagtgaggggccctcaggctgagcccagacacaaacctccctgcaggggcgcgcggctccaccagggggcgcacaaaacgcactgagcccagattctggtcctgcacaggcgcagagtgagaccaagccctggtttcctgtcagggatttagggtttcctctcctgtaacagttttgagggaagaattctactttttgattctgtccctcccaacttcaatgacggattgaaagtttgatgtaaaaggaagaagtcctaaatgaacaatttggatcatggacagcgactgtgctcaccaggatcagagatgtgggaatattgaggacactattgagtctcttccaacctgactcaggacagcaccctcagggcactgaaagctttggacagtttcagttttccctgtataaccagggacagctgagacagggtcgttgatctgttaacagcaactattccactcatccctctcctgccacaaccagcaagtgtgcactgaaccaacctttgactttatatgtgggtgatccacactcactttctgcagactttaacccgacctgcatttccctttaatcctggaacagtctgtggtccctgtgtgaacgtcacagcactcaggaatgtactgcagctcagctgtgtctcaggctgggcttctgcaggcacctgggaagcctacagggacttcctcatcctctaggtcctgggaccctcctgtgggctccctgcctgaactcaggagggaaatgcactggacatcagcagtcaaggtcatcactgaatggaaagtgttgggtgtgcacttccggctgatctggttctgctccagtgtcatgggaccccctgcacctgctgtggttctgggagagcagaaagtgggacacacagaggctgtgcactctggggctggagtccacatcacagggagctgtgtctgtgactccagcatgatgcccagtgtcctgaggctgaatcacagctgcaggaagagccagtcccagagaccatgtatccagagtccctgctcttctctccatgtctatgctgactggcgtcatcaatgtattttcagtctttcatcagttttagagagggagacacccaggctgcatatcagagtcctggacagagcccatttacacaataccacacttgtactgacaatgcaccctggaagacagtagatgatggatctgttatgaggccccatcaccaaggtgggaacactgatgcagttccatgctccagggttccagctgccaagccttgagtgcactgccttcatttatcatttctataaatctccatatatacttccttttaaatataactctgtccatttgtcccattatccattccttcttcaatgctaatttcactggattatgtgtgtgaactcttgagaatgacgctgctttaattgaacaggggactgcagagatgtttgtcacagtgactgcacatcccgtggtctcctccctggatttcatattccttctacccaggcatggtgttggaggatcctgtgataattctatttctcagcttctgatgttttccatgaaagctttcctaatttacctgactccagcctttaccaggttatcatctctctcttcctgcacaacatgtgtcagctctggtatgtctggtgatactcagtctaagaaagggatggggtatctcattgtttctccaacatgtacgtgcatgatgatcccagatttaaagcatttttatacatttgcctttatatattttattttaaaaattacagatacactttcacctcttttaaaacttgtatttgtgtatttgtccaaaaggaaaaagagacagagactgacagacagtgatctactgaatcctggtaacttcccagatgcccataaaagctgagttgggtcagatcatacaggtgcatagaactcagtccaggtctcacacatgggataaactcagacttctcatactgcctcccagagtgcacattggcaggaatctgaaattgggatctaaactgggacataaacctgagcatcctgatgcaggaggcaggaatcccacgtgataccctcaatgctgctcctatcacccaccttgtcagtcactgcatttaaaccattgattgcttcccctgtgattcagttgcttgagttcattcaacatttggatctaggctcctaatcatatgtacaattatctttcatttattttgaatatctatgtatttgatttgaaaggcagtattatagcaagagaggaagagaccaacagagggagagagaagcttccatccactggtttccttcctgaatggctgcaaaggctgggcaagggcaagactgtagccaggagcctggaacttcctccagtttcccacagagctcgaaggggacacacacttgagtcatcgttgacagagttctctggtccatgagcagggagctggatttgaagtgcagcaagcaagatctgaacccatgctgctgagtgaagctgcatagggatggcagcttaacctgtggggccacaatgttggggagtaggccatgagggttgctgcctgcattgaagggaatacgacccttagaaagacccttcaggccggcgccgcggctcgccagactaatcctctaactgcagtgccggcactccgggttctagtccaagttatggcgccggattctgtcctagttgctcctcttccagtccagctctctgctgtgacctgggagtgcagtggaggatggcccaagtgcttgggccctgcaccctcatgggagaccaggaagaagcacctggctcccggcttcgaataggcacagcgcgctggtggaggcggacatttgggtgataaaccaacggaaggaagacctttctctctgtctttctctctctctctatctctgcctgtcaaaaaaaaaaaaagaaagaaagaaaagaaaagaaagtaagacccttcagtaacttaatttttaaatttgagttataacacatgaatcagagaggagaatgagagaaagagagatgttccgacactgtgctttcccaaatgttgctgtggccaggtctgcttcccagcttagcccggtctcaggaaaacaatcaggtgcatccacaagcgtgacagggcccaaaattcctcccataaacttctgggtcctggggctgcaggagcaggaaactggtactgggagccagagccacacatgggaccctggcactctcttgggggatgtgctcatcttaaacagtgcaaatttcaatttattatttcctttatttccatgaaatttgatgcactcagatgcacctacgtgaaacctggtcctctgtgcatctctctgttaaaaatggaatccagcaaaagtgctccttgttctgctgctggcagggagttctgcagacctcaccaggaagccccagtgagtgctaagggtggactggggcagagctgagtcctgtggtgaggggcatggatcaaggtgctggggactcctcttaccacactggagtggggacacatccacactgtactgatgatttctcctgtaacgttgaaatggaccaagacctaagggaacccatgaatacacattgtaggtccattcacataaaaggaccaagagagggttcagtgtgcaatgagagcatacaatttatcactcatcccacatatgaataatgtcagactgccccgggacactctcatcagtctggacactatcatactaaggagtctgacgccagggctgctatataggggcagcacatgcaaatagggctccctctgcccatgaaaaccagcccagccctcactctgcagctctggcacaggagctccagccccaggactcccaggtgtccactcagtgatcgcactcaacacagacgctcaccatggagactgggctgcgctggcttctcctggtcgctgtgctcaaaggaaatgaagggccagtgcccgagctcactaggctaatcctccgcctttcggcgccagcacacagggttctagtcccggttggggcgctggattctgtcccggttgcccctcttccaggccagctctctactgtggccagggagtgaagtggaggatggcccaagtacttgggccctgcaccccatgggagaccaggataagtacctggctcctgccatcggatcatcgcggtgagccggcctcagtgagctgacacggtgaccattggagggtgaagcaacggcaaaggaagacctttctctctgtctctctctctctcactgtccactctgcctgtcatataaaaaggtaatgatggagaatgcagggcactgagtttgggagaggatgtgagagagagtgtgagtgacagtttcgtgatcatgtcgtctgtgtttgcaggtgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagacacagtgaggggccctcaggctgagcccagacacaaacctccctgcaggggcgcgcggctccaccagggggcgcacaaaacgcactgagcccagattctggtcctgcacaggcgcagagtgagaccaagccctggtttcctgtcagggatttagggtttcctctcctgtaacagttttgagggaagaattctactttttgattctgtccctcccaacttcaatgacggattgaaagtttgatgtaaaaggaagaagtcctaaatgaacaatttggatcatggacagcgactgtgctcaccaggatcagagatgtgggaatattgaggacactattgagtctcttccaacctgactcaggacagcaccctcagggcactgaaagctttggacagtttcagttttccctgtataaccagggacagctgagacagggtcgttgatctgttaacagcaactattccactcatccctctcctgccacaaccagcaagtgtgcactgaaccaacctttgactttacatgtgggtgatccacactcactttctgcagactttaacccgacctgcatttccctttaatcctgaaacagtctgtggtccctgtgtgaatgtcacagcactcaggactgtacttgcagctcagctgtgtctcaggctgagcttctgcaggcacctgggaagcctacagggacttcctcatcctctaggtcctgggaccctcctgggggctccctgcatgaactcaggagggaaatgcgatggacatcagcggtcaaggtcatcactgaatggaaagtgttgggtgtgcacttccagctgatctggttctgtcaagtgtcgtgggaacccctgcacctgctgtggttcagggagagcagaaagtgggacacacagaggctgtgcactctggggctggagtccacatcacggggagctgtgtctgtggctccagcatgatgcccagtgtcctgaggctgaatcacagctgcaggaagagagagtcccagagaccatgtgtccagagtccctgctcttcactccatgtttgtgctgactggggtcatcaatttatttggagtctttcattaatattacaggctgcatatcagagtcctggacggagcccatttacacattcaccacacttgtactgacaatgcaccctggaagacagtagatgatggatctgttatgaggccccatcaccaaggttggaacactgatgaagttccatgctcctgggtttcagctgccaagccttgagtacaatggcctttatttaccatctccataaaacattggcaagcacaccagtattttccgtttttgccgtttcatttttataaatgttttataaataataattggatatagacatatgaggtgcaaggatatgtgttcaaaattgaatgtagcaaattgatggaattatgaagtcattcttattgacatgctcatcacaaaatccacatgttcccatggtagattgtcagttgtcttctgttttggaattctgtagacacaatatttgcttaactgctgtcaccatgctgtacagtagatccctcaacatgtggatcctgtgggactgaaactctgaccttgctccaatgtctcctctgttccatgcccttttcttccattattgattccttcttccatgaaaatttcactggattatatgtgtgaacactcgtgaacgacgctgctttaattgcacatggaactgcagttgtagtttctatagagactgtgaatcccatgcacatctccctgggatttcacattcctgctacccaaaatgctgtttgaagatcctgtgataactgtatgtctcagtttttgatgactttccataatggatttactaatttacctgactccagccttgtacaaccagagtggtcatctctcttccttcacaagaattgtcagctctggcttgtctggtaatactcattctaacatgaaggatggacatctcattgtgcttctaaaatgtgcatacatgatgatctcagatttatggcattttacatgtttgcttttatatcatttcttaaattttatagatgtaatctacagttaaaaattcatagattttattttaaaatttgtctttatgtatttatctaaaaccacaaagagactgagactgacagtgagattctatctcctggtcactaccaagagggctacaaatgcttcagttagatcaggtgacagccaggggcttggaattctgtcaggtctccacatgggagtacttggaacttcacctatggccacgagaaccaaactaggacacagcactaaagaacctgattcgggggccggcgccgcggctcactaggctaatcctccgcctttcggcaccggcacaccgggttctagtcccggtcggggcgccgtattctgtcccggttgcccctcttccaggccagctctctgctgtggccagggagtgcagtggaggatggcccaggtgcttgggccctgcaccccatgggagaccaggagaagcacctggctcctgccatcggatcagcgcggtgcgccagccgcagtgcgacggccgcggcggccattggagggtgaaccaacggcaaaaggaagacctttgtctctgtctctctctctcactgtccactctgcctgtcaaaaaaaaaaaaaaaaaagaacctgacacaggaggcagcaatcccacatgctaactccagtgctgctcctgtcaccaccttatcagtcactgcatttaaacaattgatttcttcccttgggattcacttctctgtgtttattcaacatttgcatataggctcctaatgatatggataattaatctttcatttattttaatatctatttattttgtttgaaaggcattgttatagcaagagatgtcgtctgtgtttgcaggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagacacagtgaggggccctcaggctgagcccagacacaaacctccctgcagggggcgcacaagacacactgagtgcagattctggtcatgcataagtgcagaaggagcccaagccctggtttcctgtcagggaactggggtttcctctcctgcaacagttttgagggaagaattcttctttgatgattctgaccctgtactgactctctgatgtgacaggagaagtcctacatgaacgaatttaggttcagtggtctccagtatcagagatgtgggacaatctggggacttagtgagtgttgtccagcctgagtcaggacagagttcataggacactgccgactttagggcaattttacttttccctttcaatccagcaatagctgagccagggtttgagtttaaaaatctgctatttaagtatctctctcctttcaaaacgagcgactgtgctgaactgaaccaaccgtcttattttaaactgtgagtgttctgcatcatttctaacagactttatacccgatctccattttcctttaatcctgaaacagtctgtggtccctgtgtgaacgtcacagcactcaggaatatacttgcagctcagttgtgtctcaggctgagcttctgcaggcacctgggaagcctacagggacttcctcattctctaggtcctgggaccctcctgtgggctccctgcctggactcaggagggaaaaacactggacatcagcagtcaaggtcatcactgaatggaaagtgttgggcgtgcacttccatctggtctagttccgctccagtgtcgtgagaccacctgcacatgtgtggttcagggagaggagaaagtgggacacacagtggctgtgcactctggggctggagtccacatcacggggagctgtgtctgtggctccagcatgatgcccagtgtcctgaggctgaatcacagctgcaggaagagccagtcccagagatcatgtgtccagagtccctgctcttcaattcatgtctatgctccaaatgtcaatccatttggagtctttcattaacattacagtgggagtcactcaggctgcatatcacattgctggatggagcccattttcacgctttcccatacttgtactgacaatgcaccctggaagacagtagatgatggatctgttatgaggccccatcaccaaggagggaacactgatgcagttccaagctcctgggttccagctgccaagcctgagtgcactgccttttttaatcatctccataaaacattggcaaacacaataccagtatgcagagatctgaatcttcatgactggccattgttcatccttttatcccatgtagctacctacatcacatattatgtgtcttcctggcctggatggttagcagagtgtacttttagtgacatattatcctaggcacattattctccagggtcatccaagttgtccaaaattacagaatttcttactctgtactgcttttaaactccttttaaaatgtaactttgtccatttcttcattttccattctttcttccatgagatgtcactggatcatatgtgtgaactcttttgaatgaactcttttaaatgaacaaggaactgcagaggtgtttggcacagtgactgcagatcccgtggacacctccctgggatttcatattcattgtaccatgcaatggtgcttgaagatcatgtaataattctgtttctagtttttgatgcttttccatacggttttactaattaacctgacaagacttctaccagggttatcatctctctctacctccataaaacatgtcagctctggtatgtctgataatagccattctaactggagcgatgcgatgtctcattgtgcttccaacatggacatacatgttggtcccagatttatagcattttacatgtttgcctatatatcttcttttaataatttatagatattatataaattttaaaatttatcattttatttgagaacttgtctttatgtatttgtacaaaaccacagagagactgagactgtcagtgatcttctaattcctgcgtcacttccccactggctacaaaagattttgctgggtcaggtgacagccaggtgcttggaattctgtccagggctcccacgtgggagtacttggaactacacctacgcctcccagagtgtgctcaggcaggaatatgacactggaaccaaacaaggacacagcactaagcatcctgatacgggaggcaggaatccctcaggctcactccagtgctgctcctgtctccaccttatcatcactgcatgtacacaattgatttcttcccttgggattcagttgcttgagatcattcaacattaggaaacaggctcctaatcatatgtacaattaatcttcaatgtattttaagtatctatttattttattttacaaacagtgttatagcaagagaggaagagatcaacaaatggagagagaattccatccactggttaacttcctgaatggctgcaaaggctggggatggctcagcctaaattcaggagcctgacttggatcatggtagacagttttcaccattgcactgcctacctctgtgagttcaagcttgtgcactgcatgtataactaatgtcacatactgtgtgtccacatctacctggatcatttcttttagtatgaatgctccaggctgacccacatttcctaatgacagaacaacctccttcttaatactgaataatattcttagtctaaatgtgaaagaatccattcactgttttatgcacacttgttctttgtagactgaactattgtgaacaaagctgcattacccaaacgcaggactgcgggtgaattgtgacacagtgacttctacccagtgcttgagctaaactcaaagtcatggttacagaacagggaagcgtggccggcgctgtggctcactaggctaatcctccgccttgcggcgccggcacactgggttctagtcacggttggggcaacggattctgtcctggttgcccatcttccaagccagctcactgctgtggccagggagtgcagtggaggatggcccaagtgcttgggccctgcaccccatgggagaccaggagaagtacctggctcctgccatcggatcagcgtcgtgcgccggccacagcacgccaaatgcaacggccattggagggtgaaacaacggcaaaggaagacctttctctctgtctctctctctcttactgttcactctgcctgtcaaaaaataaaaaaaagaacagggaagagggaacacagggcagctgataccagggcagaaagcaccaccaaaggcaggaataattctgcccacaccactttgggctgactcagttcaccacaacacacaacaggttccaagaatgactagaactgaggtctccaggcctcccaacagagtgatggaaaggaggtggaaatgtgaatgacagtgagttcatctgtgcccatttctaccatgcacattccagtagcacacaaaccccactaccatgtacagtgttctgtgttcaggaacagttttaaacagtttaaacagtttttaaactttaaggcaatggatgaataaggaaaaaaacatagttaaccttaaaaaattcacttgagtatttcatctatttaaaagtgggtgacaggcattaggacaaaattggctaagtccccactagggtcacctgtgttcccatcagagaactgactgagcccagcctcacggcttcccacacttttccctcataatgcatcatgggaaactgtagatgatgctacaagcaaatgaacccctaccaccgacgttggaattacagacacagtttattgctccagggttcagaaagactaactcctagatgtcataggcatttggggtgtctggggctgtcaacccaaaggcataaatttccccttgtcacttttctgtccatctctacatttctgtctctctcaccccttctctctctatcactgtaccaatgtctttcatatagatgataaagaactaatggttatttaaataaatgagggacatgatattgctaacactcgatatgaagggtacacacatattaaaatgaaacaaggtcattgccttcaagtttttaaaattatgataacataaaaattcacatgatcttaattctatcataaccatcacccaacacaccaagaacacagacaacttcccagggccctgtcctgttgaggcatctgaccccatgcctgctatctaggggcagcacatgcaaatagggctccctctgcccatgaaaacctgcccagccctcaccctgcagctctggcacaggagctccagcctcaggactcccaggtgtccactcagtgaacgcactcaacacagacgctcaccatggagactgggctgcgctggcttctcctggtcgctgtgctcaaaggtaatgatggagaacgcgggacactgagtctgggagaggacatgagtgagagacacagagagtgtgcgtgacagtgtcctgatcatgtcgtctgtgtttgcaggtgtccaatgtgaggtgcagctggtggagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacaccgcgtctgtgaaaggcagattcaccatctcaagagatggttccaaaagcatcgcctatctgcaaatgaacagcctgaaaaccgaggacacagccgtgtattactgtactagagacacagtgaggggccctcaggctgagcccagacacaaacctccctgctaccgttcgtatagcatacattatacgaagttatggccggccacgcgt

SEQ ID NO: 191 - DNA, 13971 bp, Artificial Sequence
  Humanized heavy chain locus
ggcgcgccggaagcctacagggacttcctcatcctctaggtcctgtttctctcctgtggggctccctgcctgaactcaggagggaaatgcaccggacatcagcggtcaaggtcatcactgaatggaaagtgttgggtgtgcacttccagctgatctggttctgctccagtgtcgtgggaacccctgcacctgctgtggttcagggagagcagaaagtgggacacacagtggctgtgcactctggagctggagtccacatcacggggagctgtgtctgtggctccagcatgatgcccagtgtcctgaggctgaatcacagctgcaggaagagccagtcccagagaccatgtgtccagagtccctgctctttactccacgtctatgctccaaaggtcaatccatttggagtctttcattaacattccagtgggagtcactcaggctgcatacagagtgctggacagagcccacttacaggctttcccatacttgtactgaaatgcaccctggaagacagtagatgatggatctgttatgaggccccatcaccaagaagggaacactgatgcagttccatgatcctgggttccagctgccaaaccttgagtacactgcctttatttatcatctccataaaacattggcaaacacaacaccagtattcagagatctgaatcttcatgactggccattgttcatccttttatcccatgtaggtagcatcacatattatgtgtcttcctggcctggatgcttagcagagtgtacttttactgacatattatcctaggcacattattctccgggatcatccaagttgtccaaaattacagaatttcttactctgtactgcttgtaaccttccttttaaaatgtaactttgtccatttctttcattttccattcttgctttcatgagatgtcactggatcacatgtgtgaactcttttgaatgacggtgctttaaatgaacaaggaactgcagaggtgtttgccacagtgactgtagattccgtggacacctccctgggatttcatattcattgtaccatgcaatggtgcttgaagatcatgtaataattctgtttctagtttttgatgcttttccataatggttttactaattaacctgacacagacttgtaccagggttatcatctctctctacctccataaaacatgtcagctctggtatgtctgataatagccattctaataggaaggatgcgatgtctcgttgtgcttctaacatggacatacatgatggtcccagatttgtagcattttatatgtttgtctttatatcttcttttaaaatttataggtgtaccataaattttaaaatttatcattttatttaaaaatttgtctttatgtatttgtccaaaaccacaaagagactgagactgacagtgatcttctaactcctgggtcacttccccaatggctacaaaagcttcagctgggtcaggtgacagccaggtgcttggaattctgtccagggctcccacgtgggactacttggaacttcacctacggcctcccagaggggcttaggaaggaatatgacactggaaccaaactaggacacagcactcagcatcctcatacaggagcaggaatccatcaggctcactccagtgctgctcctgtcaccaccttatcatcactgcatttaaggaattgatttcttcccttgggattcagttacttgagatctttgaacattaggaaataggctcctaatcatatgtataatcttcaatttattttaagtatctattttattttagagacagtgttatagcaagagatgaagagaccaacggatggagagagaagcttctgtccagtggttcactttgtgaatggctgcaaaggctatgatggctgagcaagaaaccaggagcctggaacttcctctagtttcccacagggctggaaggggacaaacacttgggtcatggtagacagtgatcaccattgcaatgcctacctctgtgagttcaattgtggactgcatatacaaataatgtcacatactatgtgtccacatctacctggattatatcttttagtatgtatactccaagctgacccatgtttcctactgacagaacgacctccttcttaacactgaataatatccatgtccaagtgttaaagaatccattcactgttttatgcgcacttgttctttgtagactgaactattgggaacacagctgcattacctgaacccaggactacgggtgaattgtgacacagtgacttctacccagtgcttgagctgaactcagagccatgattacagaacagggaagagggggaacacagggcagctgataacaggacacaaagcaccactcacaggaaggaataattctgcccacaccacagtgggctgactcagttcaccacaacacacgacaggttccacaaataactagaactgaggtctccaggcctcccaacagagtgatggaaaggaggtggaaatgtgcatgacactgagttcatctgtgcccatttctaccatgcacattccaggagcacataaaccccactaccatgtacagtgttctgtgttcaggaacagttttaaactaaggcaatggatgaataaatgaacaacacatagttaaccttaaaaaatccacttcagtctttcatctatttaaaagttggtgacaggcactaggacaaaattggctaagtccccactagggacacccgtgttcccatcagagaactgactgagcctagcctcacggcttcccacacttttccctcataatgcaacatgggaacctgtagatgacgctacaagcaaaggagcccctaccaccaacgtttgaattacagacacagtttcttgctccagggttcagaaagactaactcctaggggtcataggcatttgggatgtatggggctgtcaacccaaaggcagaaatctcccattgtcacaatttctgtccaactctacatttctgtaactctcaccccttctctctctatctctgtcccaatgtctttcatatagatgataaggaactaaaggttatttaaataaatgaggaacatgatattgctaacactggatattaagggtacacattgaattaagatgaaataatgtatttgtcttcaactttttaaaataatgataacataaaaattcacatgatctgaattttatcacagccatcagcgtacacccccaggtcaccacatctgccctgggccctgtcctgtctgaggcatctgaccccatgcctgttattagcagcagcacatgcaaatggggcctccctctgcccatgaaaaccagcccagccctcaccctgcagctctggcacaggagctccagccccaggactcccaggtgtccactcagtgatcgcactcaacacagacgctcaccatggagactgggctgcgctggcttctcctggtcgctgtgctcaaaggtaatgatggagaacgcggggcactgagtctgggagaggatgtgagtgagagacacagagagtgtgagtgacagtgtcttgaccatgtcgtctgtgtttgcaggtgtccagtgtgaggtgcagctggtggagtctgggggaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcaaactctgtgaagggcagattcaccatctccagagacaattccaagaacacgctgtatcttcaaatgggcagcctgagagctgaggacatggctgtgtattactgtgcgagagacacagtgaggggccctcaggctgagcccagacacaaacctccctgcagggatgcgcggctccagcagggggcgctcaagacgcactgattgcagattctgatcttgcacaggcgcagaaggagatgaagccctggtttcctgtcagggatttggggtttcctctcctgtaacagttttgagggaagaattctacttttttattctgtccctcaaacttcaatgacggggagaaagtttgatgtaaaaggaagaagtcctaaatgaacaatttggttcatggacagcgactgtgctcaccaaagtcagagatgtgggaatattgaggactctattgagtctcttccaacctgactcaggacagcaccctcagggcactgaaagctttggacagtttcagttttccctgtataaccagggacagccgagacagggccgttgatctgttaaacagcaactattccactcatccctctcctgccacaaccagcaagtgtgcactgaaccaacttttgactctacatgtgtgtgatccacactcactttctgcagactttaacccgacctgcatttccctttaatcctggaacagtctgtggtccctgtgtgaacgtcacaacactcaggaatgtactgctgctcagctgtgtctcaggctgagcttctgcaggcacctgggaagcctacagggacttcctcatcctctaggtcctgggaccctcctgtgggctccctgcctgaactcaggagggaaatgcactggacatcagcagtcaaggtcatcactgaatggaaagtgttgggtgtgcacttccggctgatctggttctgctccagtgtcatgggaccccctgcacctgctgtggttcagggagagcagaaagtgggacacacagtggctgtgcactctggggctggagtccacatcacggggagctgtgtctgtggctccagcatgatgcccagtgtcctgaggctgaatcacagctgcaggaagagccagtcccagagaccatgtatccagagtccctgctcttctctccatgtctatgctgactggcgtcatcaatgtattttcagtctttcatcagttttagagagggagacacccaggctgcatatcagagtcctggacagagcccatttacacatttctcatacttgtactgacagtgcaccctggaagacagtagatgatggatctgttatgaggccccatcaccaaggtgggaacactgatgcagttccatgctcctgggttccagctgccaagccttgagtacactgcctttatttatcatctccataaaacattggcaaacacaacaccagtattcagagatcttaatcttcatgttttgcctcagttcaccacaacccatgacatgttccaccaataactagaactgaggtttccaggcctcccaacagagtgatggaaaggaggtggaaatgtgaatgacactgagttgatctgtgaccatttctacaacacacagattccaatagcacactacaccccactaccatgtacagtgttccgtgttcaggaacagttttaaactaaagcagtgaatgaataagggaacaaatcatagttaaccttaaacaaatccacttatagtctttcatctgtttaaaagtgggtggcaggcattaggacaaaattggctaagtccccgctagggacacccatgttcccatcagattgttgcttgagcccatcctcacagtttccaatactttttcctgataatacatcttgggaaactgtagatgacgctacaagtgaatgagaccctaccaccgatgtgggacacacagttttctgctccaggttttagaaagtctaactcctagatgtctcaacattcatgtttctctcactccttctctctctgtcgctgtttcaatgtcattagaatagttaataatgaaccaatggttattttaaaaatgaaggacatgatactgctaacattggatataaagagtacaaacattaaagtgaaatgaggtattgccttcaaatgtttaaaaataataacataaaatttgccttgatctgaatcctatcatagccatcaccccacaccaccaggacacccacatctgccctaggcacagtcctgtctgaggcatctgaccccatgcctgctatataggggcagcacatgcaaatagggcctccctctacccatgaaaaccagcccagccctcaccctgcagctctggcacaggagctccagccccaggactcccaggtgtccactcagtgattgcactcaacacagacgctcaccccatggagactgggctgtgctagcttctcctggtcgctgtgctcaaaggtaatgatggggaacgcggggcactgagtctgggagaggatgtaagtgagagacacagagagtgtcagtgacagtgtcctgaccatgtcgtctgtgtttgcaggtgtccagtgtgaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagatgacacagtgaggggccctcaggctgagcccagacacaaacctccctgcaggggagtgcggctccaccagagggcgcgcaagacgcactgagcacagattctggtcctgctcaggcgcagagggagatgaagccctggtttcctgtcagggatttgggtttcctctcctacagttttgagggaagaattctccttttatgactctgtcccttcctttgacttcactgacgtagagaagtttgaagtgacaggaagaagtcctaaacggacacattcaggtttgtgaacgatgacagtggtcaccaggatcagagatgcaggactatctggggacctcgtgagtgttgtccagtctgactcaggacagcgttccaggacactgccgactataagacaattttggttttccttcaaacccagacagacccgagccagagtcttgatttgctacctcagttttataagtcgtcccatcctcctgtcagagcagcctgtgtgctgaactgaaccaaccgtcttattttaaactgtgggtgttctgcattcactttctacagactttatacccaatctccatttccctttaatcctggaacagtctgtggtccctgtgtgcacttccagctgatctggttctgctccagtgtcatgggaccccctgcacctgctgtggttcagggagagcagaaagtgggacacacagtggctgtgcactctggggctggagtccacatcacggggagctgtgtctgtggctccagcatgatgcccagtgtcctgaggctgaatcacagctgcaggaagagccagtccaagagaccatgtgaccagagtccctactcttctctccatgtctatgctgactggcgtcatcaatgtattttcagtctttcatcagttttagagagggagacacccaggctgcatatcagagtcctggacagagcccatttacacaataccacacttgtaactgacaatgcaccctggaagacagtagatgatggatctgttatgaggccccatcaccaaggtgggaacattgatgcagttccatgcttctgggttccagctgccaagccttgagtacactgccttcatttatcatctccataaacattggcaaacacaacaccagtattcagagatcaatcgtcatgattggccatcattgctatttcatattcctaaatgtttgataaataatattgagtatagctctatgaagtacaatgatatgtgtggtcaaaatgaatgcatactgagaggaattgtgaagtcagacttgatgacacattcataccacaacacatgtttttggtggagttcacctgtctcctgctcttaagagatttctactcacaatattctcttaacctctgtcaccatgctgtgcagtagatccctcagtgtgtggagcctgtgggactgaaactctgaccttgctccagcgtctcctctgttcctccctcgctcagactttggtcttcaccattgtactttctgcctctgtgagttcagccttttatcccatgtaggtagcatcacatattatgtgtcttcctggcctggatgcttagcagagtgtacttttactgacatattatcctaggcacattattctccgggaccatccaagttgtccaaaatcacagaatttcttactctttactgcttataaacttccttttaaaatataactttgtccatttctttcataatccattcttgcttccatgagatgtcactggatcatatgtgtgaactcttttgaatgacggtgctttaaatgaacaaggaactgcagaggtgtttgccacagtgactgtagatcccgtggacacctccctgggatttcatattcattgtaccatgcaatggtgcttgaagatcatgtaataattctgtttctagtttttgatgcttttccataatggttttactaattaacctgacacagacttgtaccagggttatcatctctctctacctccataaaacatgtcagctctggtatgtctgataataggcattctaacaggagggatgggatgtctcattgtgcttctaacatggacatacatgatggtcctagatttgtagcattttatatgtttgtctttatatcttcttttgaaatttatagatgtaacataaattttaaaatttatcattttattggccagcgcatggctcactaggctaatcctccacctgcggcaactgcactccgggttctagtctcggtcgggcgctggattctgtcctggttgcccctcttccagtccagctctctactgtggcccaggagcgcagtggaggatgatccaagtgcttgggccctgcacccgcttggagaccaggagaagcacctggctcctggctacggatcagcgcggtgcagcggctacagcggccattggagggtgaaccaacggtaaaggaagacattgctctctgtctctctcactgccactgtccactctgcccatcaaaaaaatttatcattttatttaaaaatttgtctgtatgtatttgtccaaaaccacagagagactgagactgacagtgatctcctaactcctgggttacttctcgatggatacaaaattcagctaggtcaagcgacatccagttgcttggaattctgtccagggctccacgtgggactacttggaacttcacctacggcctcccagaggggcttaggcaggcatctgaaaccggaaccatactaggacacagcactaagcatcctgacacgggaggcaggaatccctcaggctcactccagtgctgctcctgtctccaccttatcatcactgcatttaaggaattgattcagttgcttgagatctttcaacattgggaaataggctcctaatcatatgtataatcaatcttcaatttactttaagtatctatttattttattttaagacagtgttatagcaagagaggaagagaccaacagatggagggagaattccatccactggttaacttcctgaatggctgcaaaggctagggatggctgagcctaaagtcatgagcttggaacttccaccagtttcccacagggaggaaggggacaaacccctggttcatggtagacagtgatcaccattgctcttcttatctctgtgagttcaacttgtggagttcaacttgtgcatgtataactaatgtcacatactatgtgtccacatctacctggattatttctgttagcatattatgctccaggctgacccacgtttcctaatgacagaacaacctccttcttaatactgaataatattctatgtccaaatgtgaaataatccattcactgtttaatgcacacttgatttattgtagactgaactattatgaacaaaactgcattacctgaacccaggactgcgggtgaattgtgacacagtgacttctacccagtgcttgagctgaactcagagccatgattacagaatagagaagacagtggaacacagggtggctgataccagggcacaaaacaccaccaaaggcaggaataattctgcccacaccacagtgggctgactcagttcaccacaacccacgacaggttccacaaataactagaactgaggcctccagacctccaaacacagagtgatggaaaggaggtggaaatgtgcctgacactgagttcatctgtgcccatttctgcatgcacattccaatagcacacaaaccccactaccatgtacagtgttctgtgttcaggaacagttttaaacagtttaaacagtttttaaattttaaggcaatgatgaataaggaaacaaaacatagttatcctaaagatatccacttgcagtccttcatctgtttaaaagtgggcgacagccattaggacaaaattggctaagtcaccactagggtcacccgtgttcccatcagagaactgactaagcccagcctcacggcttcccacacttttccctcataatgcatcatgggaaactgcaggtgacactaagagcaaatgaggccctaccactgacattggaattacagtcacattttcttgctccagggttcagaaagactaactcctaggggtcataggcatttgggatgtctggggctgtcaacccaaaggcagaaatctccctttgtcaccttttctgtccatctctacatttctgtatctctcaccccttctctctctatcactgtcccaatgtctttcatatagatgataaggaactaatggttatttaaataaatgaaggacatggtattgctaatactcgatatgaagggcacacacatattaaaatgaaacaaagtattttcctttaactttttaaaataatgataacataaaaattcatatgatctgaatcttatcacagccatcaccgtacacccccaggtcaccacatctgccctgggccctgtcctgtctgaggcgtctgaccccatgcctgctatataggggcagcacatgcaaatagggcctccctctgcccatgaaaaccagcccagccctcaccctgcagctctggcacaggagctccagccccaggactcccaggtgtccactcagtgatcgcactcaacacagacactcaccatggagactgggctgcgctggcttctcctggtcgctgtgctcaaaggtaatgatggagaacgcggggcactgagtctgggagaggatgtgagtgagagacacagagagtgtgagtgacagtgtcctgaccatgtcgtctgtgtttgcaggtgtccagtgtgaggtgcagctggtggagtctgggggaggcttggtacagcctggggggtccctgagactctcctgtgcagcctctggattcaccttcagtagctatagcatgaactgggtccgccaggctccagggaaggggctggagtgggtttcatacattagtagtagtagtagtaccatatactacgcagactctgtgaagggccgattcaccatctccagagacaatgccaagaactcactgtatctgcaaatgaacagcctgagagccgaggacacggctgtgtattactgtgcgagagacacagtgaggggccctcaggctgagcccagacacaaacctccctgcaggggagtgcggctccaccagggggcgcgcaagacacactgagtccagattctggtcctgctcaggcacagagggagatgaagccctggtttcctgtcagggatttgggtttcctctcctacagttttgagggaagacttctacttcaggattctgtcccttacactgacgccactgacgtagagaagctttatgtgacaggaagaagtcttaaatggacacattcaggtttgtgaacgatgacagtggtcaccagggtcagagatgtgagacaatcaggggacctcgtgagtgttgtccagtctgactcaggacagcgttccaggacactgccgactataagacaattttagttttccttcaaacccagacagacccgagccagagtcttgatttgctacctcagttttataagtcgtcccatcctcctgtcagagcagcctgtgtgctgcactgaaccaaccgtcttattttaactgtgggtgttctgcattcactttctacagactttatacccaatctccatttccctttaatcctgaaacagtctgtggtccctgtgtgcacttccagctgatctggttctgctccagtgtcgtgggaacccctgcacctgctgtggttcagggagagcagaaagtgggacacagagcggctgtgcactctggggctggagtccacatcacggggagctgtgtctgtggctccagcatgatgcccagtgtcctgaggctgaatcacagctgcaggaagagccagtcccagagaccatgtgtccagagtccctgctcttcactccatgtctatgctgactggggtcatcaatccatttgtgttctttcatcagtattagagagggagacacccaggctgcatatcacattgctggatggagcccatttgcacgctttcccatacttgtactgacagtgcaccctggaagacagtacatgatggatctgtatgaggccccatcaccaaggtgggaacactgatgcagtttcatgctcctgggttccagctgacaagcttgagtccactgcctttatttatcatctccataaaacatggccaacacaacaccagtattcaaagatcaatcgtcatgattggccatcgttgctatttcatattcctaaatgtttgataaataatattgagtatagctctatgaggtacaatgatatgtgtggacaaaatgaatgcatattgagtggaattatgaagtcaggcttgatgacacattcataccacaacacatgtttttggtggagttcacctgtctcctgctcttaagagatttccactcacaatattctcttaacctctgtcaccatgctgtgcagtagatccctcagtgtgtggagcctgtgggactaaaactctgaccttgctccagcgtctcctctgttcctccctcgctcagactttggtcttcaccattgtacttcctgcctctgtgccttcagccttttatcccatgtaggtagcatcacatattatgtgtcttcctggcctggatgcttagcagagtgtacttttactgacatattatcttaggcacattattctccgggatcatccaagttgtccaaaatcacagaatttcttactctgtactgcttttaaacttccttttaaaatgtaactttgtccatttctttcattttccattcttgcttccatgagatgtcactggatcatatgtgtgaactcttttgaatggcggtgctttaaatgaacaaggaactgcagaggtgtttgccacagtgactgcagatcccgtggacacctccctgggatttcatattcattgtaccatgcaatggtgcttgaagatcatgtaataattctgtttctagtttttgatgcttttccataatggttttactaattaacctgacacagacttgtaccagggttatcatctctctctacctccataaaacatgtcagctctggtatgtctgataatagtcattctaacaggagggatgggatgtctcattgtgcttctaacatggacatacatgatggtcctagatttgtagcattttatatgtttgtctttatatcttcttttgaaatttatagatgtaacataaattttaaaatttatcattttattggccagcgcatggctcactaggctaatcctccacctgcggtgacttaccgttcgtatagcatacattatacgaagttatggccggccacgcgt

SEQ ID NO: 192 - DNA, 15445 bp, Artificial Sequence
  Humanized heavy chain locus
gcgcgccgcgatcgcgaagttcctattccgaagttcctattctctagaaagtataggaacttcagggcgcgaggctcttctagggggcgcacaagacgcactgagcccagattcctgtcctgcacaggcgcagagggagatgaagccctggtttcctatcagggaattggggtttgctgtcctgtaacagttttgagggaagaattctactttttgattctgtccctcccaacttcaatgacggagagaaagtttgatgtaaaaagaagaagtcctaattgaacaatttggttcatggacagcgactgtgctcaccagggtcagagatgtgggaatattgaggacactattgagtctcttccaacctgactcccgacagcaccctcagggcactgaaagctttggacagtttcagttttccctgtataaccagggacagccgagacagggtcgttgatctgttaaacagcaactattccactcatccctctcctgccacaaccagcaagtgtgcactgaaccaacttttgactctacatgtgtgcgatccacactcactttctgcagactttaacccgacctgcatttccctttaatcctggaacagtctgtggtccctgtgtgaacgtcacagcactcaggaatgtacttgcagctcagctgtgtctcgggctgagcttctgcaggcacctgggaagcctacagggacttcctcatcctctaggtcctgggaccctcctgtgggctccctgcctgaactcaagagagaaatgtgctggacatcagcagtcaaggtcataactgaatggaaagtgttggatgtgcacttccagctgatctggttctgctccagtgccatgggaccccctgcacctgctgtggttcagggagagcagaaagtgggacacacagtggctgtgcactctggagctggagtccacatcacggggagctgtgtctgtggctccagcatgatgaccaatgtcctgaggttgaatcacagctgcaggaagagccagtcttagaccatgtgtccagagtccctgctcttcactccatgtcatgttgactggagttatcactccactttagtctttcatctatttagagagggagacatccatgctgcacatcacattgctggatggagcccatttacacatttcccatacttgtactgacagtgcaccctggaagacagtagatgatggatctgttatgaggccccatcaccaaggtgggaacactgatgcagttccaagctcctgggttccagctgccaagccttgagtacactgcctttgtttatcatctccataaaacattggccaacacaacaccagtattcagagatctgaatcttcatgattgatcatcgttgccatttcatatttataaatgtttcataaataagaattcattatagctctatgaggtacaatgatatgtgtggacaaaatgaatgcatattgagtggaattatgaactcagacttgctgacacgttcatacctcaacacatgtttttggtggagttcagctgtctcctgctcttaggagatttccaaacacagtattctcttaacctctttcaccatgctgtagagtagatccctcagtgtgtggatcctgtgggactggaactctgaccttgctccaccattctctgctcctccctcactcagactttggtcttcaccattgtacttcctgcctctgtgagttcagccttttatcccgcataggtagcatcacatattatgtgtcttcctggcctggatggttagcagtgtgcacttttactgacatattatcctaggcacattattctccaggatcatccaagttgtccaaaattacagaatttcttactctactgcttataaacttccttttaaaatgtaactttttccatttctttcattttccattcttgctttcatgagatgtcactggatcacacgtatgaactcttttgattgatggtgctttaaacgaacaaggaactgcagaggtgtttgccacactgactgcagatcccgtggacacctccctgggatttcatattcattgtaccatgcaatggtgcttgaacatcatgtaataattctatttctagtttttgatgcttttccatacggttttactaattaacctgacacagacttgtaccagggttatcatctctctttacctataaaacatgtcagctctggtatgtctggtaatagccattctaacaggagcgatgggatgtctcattgtgcttctaacatggacatacatgatggtcccagactgataacattttatttgtctgtctatatatcttcttttaataatttatagaaatgatataattttaaaatttatcattttatttaaaaatttgtctgtatgtatttgtccaaaaccacaaagagacggagactgacagtgatcttctaattcctgggtcacttccccaatggctacaaaagctttagctggatgaggcaacagcctggttcttggaattctgtccatgtgtccgcatgggactacttggaacctcacctatggcctcccagggtgtgcttaggcaggaatctggaactggaaccaaactaggacgcagcactaagaatcctgacacgggaggcaggaatccctcaggctcactccagtgctgctcctgtcaccaccttatcagtcactgcatttaaacaattgatttcttcccttgggattcagttgcttgagatcattcaacattaagaaacaggctcctaatcatatgtataattaatcttcaatttattttaagtatctatttattttattttaaagtcagtgttatagcaagagaggaagagaccaacagatggagggagaatcttccttccacaggtttccgtctgaatggctgctaagactgaagatggctcagccagaaaccaggagcctggaacttcctccagtttcctacagggttggaaggggacaaacacttgggtcatggtagacagtgatcaacattgcactgcctacctctgtgagttcaatcttgtggactgcatatataactaatgtcacatactatgtgtctacgtgtaccgggattatttctgttagcatattgtgttccaggcagacccacgtttcctattgacagaatgacctccttcttaatactgaataatattctatgtccaaatgcgaaagaatccattcagtcttctatgcacacttgctttattgtagactgaactattgggaacaaagctgcattacctgaacacaggatggcggctcaattgtgacacagagacttctacccagtgcttgacctcaactcagagtcatgattactagacacagagaagagaggggaacaggggaaggctgataccaggacacaaagcaccactcacaggaaggaataattctgcccacaccgcagtgggctgactcagttcaccacaacacacgacaggttccacaaataatgagaactgaggtctccaggctgcccaactcagagtgattgaaaggaggtggaaatgcgcatgacactgagttgatctgtgcccatttctaccatgcacattccagtagcactctataccccactaccatgtacagtgttctgagttcaggaacagttttaaacagtttaaatagttgttaaactttaaagcaatggaggaagaaggaaacaaaacatagttaaccttaaaaaatccacttgcagtccttcatctgtttaaaagtgggcgacaggcatttggtcaaaattggctaagtccccactagggacacccgtgttcccatcacagaactgactgagcccagcctcacggcttcccacacttttcctcataatgcatcatgggaaactgtagatgacgctacgagcaaaggagcccctaccaccaacgtttgaattacagacacagtttcttgctccagggttcagaaagactaactcctaggggtcataggcatttgggatgtctggggctgtcaacccaaaggcagaaatctcccattgtcaccttttctgtccatctctacatttctgtatctctgaccccttctctctctatcactgtaccaaggtctttcatatagatgaaaaggaactaatggttatttaaataaatgagggacatgatattgctaacattggatatgaggggtacacacatattaaaatgaaacaaggtcattgccttcagtcttttaaaattatgataacataaacattcatatcatctgaatcgtatcatagccatcaccctacacacccaggacaccacgtctgccctgggccctgtcctgtctgaggcgtctgacatcatgcctgctatataggggcagcacatgcagatagggcctccctctgcccatgaaaacctgcccagccctcaccctgcagctctggcacaggagctccagccccagcactcccaggtgtccactcagtgattgcactcaacacagatgctcaccatggagactgggctgcgctggcttctcctggtcgctgtgctcaaaggtaatgatggggaaggcggggcactgagtctgggagaggacgtgagtgagagacacagtgagtgtcagtgacagtgtgctgaccatgtcgtctgtgtttgcaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatgacacagtgaggggccctcaggctgagcccagacacaagcctccctgcagggacgcgcggctccaccagggggcgcaaaagtctcactgagcgcagattctggttctgcacaggcacagagggagatgaagccctggtttcctgtagggatggggtttcctctcctgcaacagttttgagggaagaattcttcttttatgattctgtccctgctactgaattcctgacatagagaagtttgaattgacaggagaagtcctatatgaaccaattcaggttcagtggtctccaggatcagagatgtgggtctatctgggtacaacgtgagtgttgtccactctgagtcaggacaacgctctcagggcactgccgactttaggacaattttagatttccctttcgaccaggacagctgaggcagggttcttggtctttataaatcagctatttaagtatctgtagcctgacaaaaagagcaagtgtgctgaactgaaccaacctttgactttacttgtgggtgatccacacaaactttcgatagactttatgctcgatttctatttccctttaatcctggaacagtctgtggtccctgtgtgaacgtcacagcactcaggaatgtacttgcagctcagctatgtctcaggctgagcttctgcaggcacctgggaagcctacagggacttcctcatcctctaggtcctgggaccctcctgtgggctccctgcatgaactcaggagggaaatgccctggacatcagcagtcaaggtcatcactgaatggaaagtgttgggtgtgcacttccagctgatctggttctgtctagtgtcgtgggaacccctgcacctgctgtggttcagggagagcagaaagtgggacacacagtggctgtgcactctggggctggagtccacatcacggggagctgtgtctgtggctccagcatgatgaccaatatgctgaggctgaaccacagctgcaggaagagccagtcccagagaccatttgtccagagtccctgctcttcactccatgtctatgctgactggcgtcatcaatccatttggagtcttagatcagttttagatgggagacacccaggctgcatatcagagtcttggacagagcccatttacacatttaccacacttgtaactgacaatgcaccctggaagacagtagatgatggatctgttatgaggccccatctccaaggtgggaacactgatgcagttccaagctcctgggttccagctgccaagcctgagtcaactgccttcatttatcatctccataatactttggcaaacacaacaccagtattcagagatctgaatcttcatgatgggccattgttgccatttcatattcataaatattttataaataagaattgagtatacctctatgaggtacaatgatatgtgtggacaaatgaatgcatattgagtggaattatgaagtcagacttgatgacacattcataccgcaacacatgtttttggtggagttcagctgtctcctgcttttaggattttccactcacaatattcccttaagctctgtcaccatgctgtgcaggagatccctcagtgtgtggatcctgtgggactgaaactctgaccttggtccaccatcacctctgttcctccctcactcagactctggtcttcaccactgtacttcctgcctctgtgccttcagctttttttcccacataggtagtatcacatattatgtgtcttcctggcctggatggtgagcagagtgtacttttactgacatattatcctaggcacattattctccaggatcattaaagttgtccaaaattacagaatttcttactctactgcttataaacttccttttaaaatgtaactttgtccatttctttcattttccattctttcttccatgagatgtcactggatcatatgtgtactcttttaaatgaacaaggaactgcagaggtgtttgccactgtgactgcagatcccgtgaacacctccctgggatttcatattcattgtaccatgcaatggtgcttgaacatcatgtaataattctatttctagtttttgatgcttttccatacggttttactaattaacctgacacagacttgtaccagggttatcatctctctctacctccataaaacatgtcagctctggtatgtctggtaatagccattctaacaggagcgatgggatgtctcgttgtgcttctaacatggacatacatgatggtcccaaattgatagcattttatatgtctgtctatatatcttcttttaataatttatagaaatgatataattttaaaatttatcattttatttcagaccttgtctttatgtatttgtccaaaaccacagagagtgagactgacagtgatcttctaattcctgggtcacttccccaatggctacaaaagcttcagctggatgaggcaacagcctggtgcttggaattctgtccatgtgtccgcatgggagtacttggaacctcacctacggcctcccagggtgtgcttagcaggaatctgaaactggaaccaaactaggacacagcactaagcatcctcacatgggaggcaggaatcccacaggctcactcaagtgctgctcctgtcaccaccttatcatcgctgtatgtacacaattgatttcttcccttgggattcagttgtctgtgttcattcaacattaacaaacaggctcctaatcatatgtataattaatcttcaatgtattttaagtatctatttattttattttaaagacagtgttatagcaacagaggaagagaccaacagatggagggagaattccttccatttgttcacttcctgaatggctgccaaaggctggggatggctaagcctaaagtcaggagcctggaacttcctctagtttcccacagggctggaaggggacaaacatggttgacagtgatcaccattgcacttcctacctctgtgagttcaacttgtggactgcatatataactaatgtcacttactatgtgtccacatgtacttgcattatttcttttagtttgtatgctccagggagacccacatttcctaatgacagaacaacctccttcttaatactgaataatattccatgtccaaatgggaaagaatgcattcactgttttatgcgcacttgctttgtttgagactgaagtattgtgaacaaagctgcaacctgacacaggactgggggtaaattgtgacacagtgacttctacccagtgcttgagctgaactcagagtcatggttactagacacagggaagagggggcaacaggggacggctgataccaggacacaaagcaccactcacaggaaggaataattctgcccacaccacagtgggctgactcagttcaccacaacacacgacagattccacaaataactagaactaatgcgtccaggctgcccaactcagagtgattgaaaggaggtagaaatgtgcatgacactgagttgatctgtgcccatttctaccatgcacattccaatagcactctataccccactaccatgtacagtgttctgtgttcaaaacagttttaaaccatttaaacagtttttaaactttaaggcaatggatgaataaggaaacaaaacatagttaaccttaaaaaatgcacttgcagtccttcatctgtttaaaagtgggtgacaggcattaggagaaaattggctaagtccccactagggacaccggagttcccgtcagagaactgactgagcccagcctcacggcttcccacacttttccctcataatgcatcatgccaaactagatgacactacaagaaaatgagcacctaccactgacgttggaattacagacatagtttcttgcttcagcgttcagaaagactaactcctagatgtcataggcatttgggatgtctggggctgtcaacccaaaggcagaaatctcccattgtcaccttttctgtccatctctacatttctgtatctctgaccccttctctctctatcactgtcccaatgtctttcatatagatgataaggaactagtggttacttaaataaatgagggacatgatattgctaacactggatatgagggtaaacacatattaaaatgaaacaaggtcattgccttcaactttttgaaattatgataacataaaaattcatatgatctgaatcatattatagtcatcaccctacaaacccaggtcacctaattctgccccaggccctatcctgtctgaggcatctgaccccagggctgctatataggggcagcacatgcagatagccctccctctgcccatgaaaaccagcccagccctcaccctgcagctctggcacaggagctccagccccaggactcccaggtgtccactagtgatcacactcaacacagacgctcaccatggagactgggctgcgctggcttctcctggtcgctgtgctcaaaggtaatgatggggaacgcggggcactgagtctgggagaggacgtgagtgagagacacagagagtgtgagtgacagtgtcgtgaccatgtcgtctgtgtttgcaggtgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagacacagtgaggggccctcaggctgagcccagacacaaacctccctgcagggccgtacgtctccaccaggaggcacacaagatgcactgaatatatattctggtcatgggtaggtgtagagggacaataagccctggtttccttttagggaattggggtttcctctcctctaatacatttgaagaaatggttctactcttacgattctgtccctgccactgacttcactgacggatagaaactttgaatagaaggaagaagtcctacgtgacaatttcgggttcatgactgacaactatcctcaccgcgatcagatatcatggggatctgtgaggacctcgtgagtcttttccagtctaactcgtgctggtgtcctcagggcgctgccgactctaggacaattttacttttccctttatatcctggagacaactgagccagggtctctggtctgttaaacctcaactatttccctctcttcctgtcaaagtagcctgtgtgcggaactgaattgacattttattttaaactgtgggtgatccacactcactttctgcagaatgtggccacctttaatcctggaacagtctgtggtccctgtgtgaacgtcacagcactcaggaatgtacttgcagctcagctgtgtctcagactgagcttctggaagcacctgggaagcctacagggacttcctcatcctctaggtcttgggacactcctggggggctccctgcctgaactcggaggggaaatgcactggacatcagcagtcaaggtcatcactgaatggaaagtgttgggtgtgcacttctagttgatctgattctgttgagtgttgtgggactccctgcacctgctgtggttcagggagagcagaaagtgggacacacagtggctgtgcactctggggctggagtccacatcacggggagctgtgtctgtggctccagcatgatgaccagtgtcctgacgctgaatcacagcttcaggaagagcaagtctcggagaccatgtgtccagagtccctgctcttcactccatgtctatggtgactggggtcatcaatgcatttggagacttccatcagtattagagagggagacacccaggctgcatatcagagtgctggacacagcccatttgcacactttcccagacaagtaactgacagtgcaccctggaagtcagtagatgatggatgtgttatgaggccccatcacgaaggtgggaacactaatgcagtttcaagctcctgggttccagctgccaagcttcagtccactggaatttatttatcatctccataaaatattggaaaatactggaaagcactacaccagtattcagagtgttgaatctccatttttgatcatttaatcatttcctttacataagtgtttgatatataataccaaaacatagacatatgaggtacaatgatatgtgttgataaataaatgtatcaaattgagtttttatgaagtcagacttattgacatgctcatcagaaaaccacatgtttccatggtagaatgtcagttgtctgctgttttggaattctttaggcacaatattcccttcactgctgtgaccatgctgtacagtagatcctcagtgtatggatcctgttggactggaactctgaccttgctccaacgtctcctctgctcctcccttgctcagacgttggtcttcaccatcgtacttcctgcctctgtgacttcatccttttatcccatgtatccagcatcacgtattatttgtcttcttgtcctgcatggttagcagagtgtacttaccctgacacattatccttggacattattctccaggatcatccgagttgtccaaaatacagaatttcctcatctgtactgccatataaacttcctgttaaatataattttgtccatttgttccattgttgattctttcttcatgaatatttcactggattgtatgtgtgaactcttgtgaatgatgctgcattagttgaacatggaagagcagaggtgtttgccacattgattgcggttcccctggacacctccctgggatttcatattccttctactcaaaattggtgtttgaagatcctgtgataattctgtttcagttttgatgaatttccataataattttacttgtttacctgactccattcttgcaccagagttatctccagcttcctccacatggattgtcagctctggattgtaggataatactcattctaacaggaaggatgggatgtctcattgtgcatctattagggacatgcatgatgggcccaatatatcattttatatgttgcctttatatcttttttaaaaagttaaagatactatttcacttattttgatatttgtatttacatatttttttcaaaaaagcaaagagactgagactgacagtgatcttctaattcctggtcacttcccagatggatacaaaagcttcagctgggttaggtgacagccatgtgcttggaattctgtccagttgtccacatggcagtacttggaacttcacctactgcctcccagaagggcttagacaggaatctgacactggaacgaaactaggacacagcactcagcatcctgacacgggaggcaggaatccctcaggctcactccagtgctgctcctgtcaccaccttatcatcactgcatttaaggaattgattgcttcccttgggatcagtggcttgagttcattcaacatttggaaataggctcctaaccatatgtataattaatctttcatttattttaagtatttattttatttgaaaggcagtgttatagcaagagagaaagctatcaacagatggagagagaagtttctattcactggttcacttcgtgaatggctgcaaaggctgggatggctgagcctgaagccaggagcctggaacttcccccagtttcccccagagctggaaggggacaaacacttgggtcatggtacacagtgatcaccattgcacttcctccctctgtgagttcaatcttgtggactgcatgtataactaatgtcacatactatgtgtccacatgtacctgcattatttctgttagcatattatgctccaggctgaccaatgatttcctaacgaccgaacaacctccttcttaacactgaataatattccatgtcaaatgtaacagactgcattcactgttttaggcacatttcactttattgtagactgaactattgtgaacaaagctgcattacatgaacccaggactgtgggtgaattgtgacacagtgacttctatccagtgcttgagctgaactcagagtcatggttactagacacagggaagagggggaacacagggcagctgataccagggcacaaagcactcacaggaaggaataattctgcccacactacagtgggctgactcagttcaccacaacccatgacagattccatgaataatgagaactgaggcctccaggcccctccaactcagagtgtaggaaaggaggtggaaatgtgaatgacattcagttgatctgtgcccatttctacaacacacagattccaatagcacagtacaccccactagcaagcacagtgttctgtgttcatgacgagtgttaaataagtcaatggatgaataaggaaacaaaacatagttaacctaaaaagaatccacttgcagtcttttatctgtttaaaagtgggaggcaggcattaggacaaaattggcaaagtccccactagggacaccggtgttcccatcagaatgaatcattcagccacacgactccccacactttttctgataatgcattttggaaaactgtagatgacactacaagtgaatgagcccctaccactgacgtgggaaacaaatttgcagttttgcgctccatgttttagaaaggctaagtcctcggtgttgtaggcacttgggatgtttggggctgtcaatcaaaggtggaaatctccctttgtcaccttttctgtccatctctacatttctctttctctcaccccttctctcactgtcactattccaatgttattcaaatagttaaaaatgaaccatggttattttaaaaatgaaggacatgataacactggattattaaggatacacacatattaaaatgaaacaaggtcattgccttcaattgtttaagcaacaatgataatgtaaagatttctatgatctgaatcctatcatagccatcaacctacaccacaggacaccacatctgccctgggcactttcctgtctgaggcatcagaccccatgcctgctatataggggcagcacatgaaaacagggcctccctctgcccatgaaaaccagcacaggcctcaccctgcagctctggcacaggagctccagcctcaggactcccaggtgtccactcagtgatcacactcaacacagatgctcaccatggagactgggctgcgctggcttctcctggtcgctgtgctcaaaggtaatgatggggaacgcggggcactgagtctgggagaggacgtgagtgagagacacagagagtgtgcgtgacagtgtgctgaccatgtcgtctgtgtttgcaggtgtccagtgaggtgcagctggtggagtctgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagacacagtgaggggccctcaggctgagcccagacacaaacctccctgcaggggagtgcggctccaccagggtgcgcacaagacgcactgagcccagattctggccctgctctgatgcagagggaaatgagccctggtttcctgtcagtgatttgtggtttgttctacagttttgcggcaagaattctacttcatgattctgtctgttccactgacttcactgacttagagaagtttgatgtgacaggaagaagtcctgaatggacacattcaggttagtgaactatgacagtggtcaccagggtcagagatgtgagacaatcaggggacctcgtgagtgttgtccagtctgactcaggacagcgttccaggacactgccgactataagacaattttagttttccttcaaacccagagagagccgagtcagagcattgatttttcaccttaattatataagtcatgacacatcctgtcggagtagcctgtgtgctgcactgaaccaactgtcttattttaaactgtgggtgttctgcattcactttctacagactttataccccatctccatttccctttcatcctggaacagtctgtggtccctgtgtgaacgtcacagcactcaggaatgtactgcagctcagttgtgtctcaggctgagcttctgcaggcacctgtaccgttcgtatagcatacattatacgaagttatggccggccacgcgt

SEQ ID NO: 193 - DNA, 26 bp, Artificial Sequence
  primer
cgcggatccgagactgggctgcgctg

SEQ ID NO: 194 - DNA, 27 bp, Artificial Sequence
  primer
cgcaagcttgaaataggtggccgtgtc

SEQ ID NO: 195 - DNA, 26 bp, Artificial Sequence
  primer
cgcggatccaggcaccctggtcaccg

SEQ ID NO: 196 - DNA, 26 bp, Artificial Sequence
  primer
cgcaagcttgtgaccagggtgccctg

SEQ ID NO: 197 - DNA, 27 bp, Artificial Sequence
  primer
cgcggatccctggagccgaaggtctac

SEQ ID NO: 198 - DNA, 27 bp, Artificial Sequence
  primer
cgcaagcttgagatggacttctgcgtg

SEQ ID NO: 199 - DNA, 27 bp, Artificial Sequence
  primer
cgcggatcccagagtgggtctgtgaca

SEQ ID NO: 200 - DNA, 27 bp, Artificial Sequence
  primer
cgcaagcttacaggcgcatgcaaatgc

SEQ ID NO: 201 - DNA, 26 bp, Artificial Sequence
  primer
cgcggatccgaggcacagtcaccatc

SEQ ID NO: 202 - DNA, 27 bp, Artificial Sequence
  primer
cgcaagcttacagtagtaagtggcagc

SEQ ID NO: 203 - DNA, 26 bp, Artificial Sequence
  primer
cgcggatccggagggaccgaggtggt

SEQ ID NO: 204 - DNA, 26 bp, Artificial Sequence
  primer
cgcaagcttaccatggtccctgagcc

SEQ ID NO: 205 - DNA, 27 bp, Artificial Sequence
  primer
cgcggatcccctcaggtgatccagttg

SEQ ID NO: 206 - DNA, 27 bp, Artificial Sequence
  primer
cgcaagcttctattgaagctctggacg

SEQ ID NO: 207 - DNA, 26 bp, Artificial Sequence
  primer
cgcggatccgtgactggcccaagaag

SEQ ID NO: 208 - DNA, 26 bp, Artificial Sequence
  primer
cgcaagcttatacaaccttggccagg

SEQ ID NO: 209 - DNA, 78 bp, Artificial Sequence
  primer
aaacagcttttcacacctcccctttctctctttgctcccctgggccctcagggagtgcatccgccccaacccttttcc

SEQ ID NO: 210 - DNA, 81 bp, Artificial Sequence
  primer
cagggttagtttgcatgcacacacacacagcgcctggtcacccagaggggtcagtagcaggtgccagctgtgtcggacatg

SEQ ID NO: 211 - DNA, 73 bp, Artificial Sequence
  primer
ggtcaggggtcctccagggcaggggtcacattgtgccccttctcttgcagcctccaccaagggcccatcggtc

SEQ ID NO: 212 - DNA, 81 bp, Artificial Sequence
  primer
cacagctgcggcgtgggggggagggagagggcagctcgccggcacagcgctcatttacccggagacagggagaggctcttc

SEQ ID NO: 213 - DNA, 77 bp, Artificial Sequence
  primer
gtgttataaagggagactgagggggcagaggctgtgctactggtacctggctgaatacttccagcactggggccagg

SEQ ID NO: 214 - DNA, 77 bp, Artificial Sequence
  primer
ggccacagaaaagaggagagaatgaaggccccggagaggccgttcctacctgaggagacggtgaccgtggtcccttg

SEQ ID NO: 215 - DNA, 32 bp, Artificial Sequence
  primer
ccaggccggcctggagttgtagatcctctacg

SEQ ID NO: 216 - DNA, 30 bp, Artificial Sequence
  primer
ccaggcgcgccaagatgcgtgatctgatcc

SEQ ID NO: 217 - DNA, 41 bp, Artificial Sequence
  primer
ggccgcggccggccatcgatggcgcgccttcgaaacgcgta

SEQ ID NO: 218 - DNA, 41 bp, Artificial Sequence
  primer
agcttacgcgtttcgaaggcgcgccatcgatggccggccgc

SEQ ID NO: 219 - DNA, 43 bp, Artificial Sequence
  primer
attcccaagcttttaattaagacgtcagcttccttagctcctg

SEQ ID NO: 220 - DNA, 55 bp, Artificial Sequence
  primer
attcgcggatccacgcgtttcgttcccaaaggcgcgcctagcgatgagctcggac

SEQ ID NO: 221 - DNA, 39 bp, Artificial Sequence
  primer
gcaggcatgcaaagcttattacaccagtgtcagtaagcg

SEQ ID NO: 222 - DNA, 39 bp, Artificial Sequence
  primer
ggtacccggggatcctcagaagaactcgtcaagaaggcg

SEQ ID NO: 223 - DNA, 39 bp, Artificial Sequence
  primer
aaattcccttaattaagacgtcagcttccttagctcctg

SEQ ID NO: 224 - DNA, 75 bp, Artificial Sequence
  primer
gaaaccggggacgcgttaccgttcgtataatgtatgctatacgaagttatgcggccgctagcgatgagctcggac

SEQ ID NO: 225 - DNA, 68 bp, Artificial Sequence
  primer
ttctctgtttttgtccgtggaatgaacaatggaagtccgagctcatcgctaagggcaccaataactgc

SEQ ID NO: 226 - DNA, 102 bp, Artificial Sequence
  primer
cacaggagagaaacaggacctagaggatgaggaagtccctgtaggcttcctaccgttcgtataatgtatgctatacgaagttattacctgtgacggaagatc

SEQ ID NO: 227 - DNA, 18 bp, Artificial Sequence
  primer
atagagagattgagtgtg

SEQ ID NO: 228 - DNA, 16 bp, Artificial Sequence
  primer
tcctgtcttcctgcag

SEQ ID NO: 229 - DNA, 17 bp, Artificial Sequence
  primer
agagacattgagtggac

SEQ ID NO: 230 - DNA, 15 bp, Artificial Sequence
  primer
agggaggtttgtgtc

SEQ ID NO: 231 - DNA, 19 bp, Artificial Sequence
  primer
actagagatattgagtgtg

SEQ ID NO: 232 - DNA, 15 bp, Artificial Sequence
  primer
aggcattctgcaggg

SEQ ID NO: 233 - DNA, 19 bp, Artificial Sequence
  primer
actagagagattaagtgtg

SEQ ID NO: 234 - DNA, 15 bp, Artificial Sequence
  primer
tcacactgacctccc

SEQ ID NO: 235 - DNA, 19 bp, Artificial Sequence
  primer
tcatggatcaatagagatg

SEQ ID NO: 236 - DNA, 16 bp, Artificial Sequence
  primer
tgcagggacgtttgtg

SEQ ID NO: 237 - DNA, 18 bp, Artificial Sequence
  primer
agaaaaattgagtgtgaa

SEQ ID NO: 238 - DNA, 16 bp, Artificial Sequence
  primer
gtgtctgggctcacaa

SEQ ID NO: 239 - DNA, 16 bp, Artificial Sequence
  primer
agagagactgagtgtg

SEQ ID NO: 240 - DNA, 16 bp, Artificial Sequence
  primer
tgcagggaggtttgtg

SEQ ID NO: 241 - DNA, 18 bp, Artificial Sequence
  primer
tgagtgtgagtgaacatg

SEQ ID NO: 242 - DNA, 17 bp, Artificial Sequence
  primer
accagctcttaaccttc

SEQ ID NO: 243 - DNA, 15 bp, Artificial Sequence
  primer
tgagtgtgagtggac

SEQ ID NO: 244 - DNA, 15 bp, Artificial Sequence
  primer
tgacgctgatcagtg

SEQ ID NO: 245 - DNA, 17 bp, Artificial Sequence
  primer
tctgaccaatgtctctg

SEQ ID NO: 246 - DNA, 16 bp, Artificial Sequence
  primer
aggtttgtgtctgggc

SEQ ID NO: 247 - DNA, 18 bp, Artificial Sequence
  primer
acaaggtgatttatggag

SEQ ID NO: 248 - DNA, 15 bp, Artificial Sequence
  primer
aggtttgtgtccggg

SEQ ID NO: 249 - DNA, 34 bp, Artificial Sequence
  primer
ttggcgcgcctgtcgtctgtgtttgcaggtgtcc

SEQ ID NO: 250 - DNA, 69 bp, Artificial Sequence
  primer
ttgcacgcgtgcagggaggtttgtgtctgggctcagcctgagggcccctcactgtgtcatcttttgcac

SEQ ID NO: 251 - DNA, 34 bp, Artificial Sequence; identical to SEQ ID NO: 249
  primer

SEQ ID NO: 252 - DNA, 63 bp, Artificial Sequence
  primer
ttgcacgcgtgcagggaggtttgtgtctgggctcagcctgagggcccctcactgtgtctctcg

SEQ ID NO: 253 - DNA, 34 bp, Artificial Sequence; identical to SEQ ID NO: 249
  primer

SEQ ID NO: 254 - DNA, 63 bp, Artificial Sequence
  primer
ttgcacgcgtgcagggaggtttgtgtctgggctcagcctgagggcccctcactgtgtctcttg

SEQ ID NO: 255 - DNA, 34 bp, Artificial Sequence; identical to SEQ ID NO: 249
  primer

SEQ ID NO: 256 - DNA, 63 bp, Artificial Sequence
  primer
ttgcacgcgtgcagggaggtttgtgtctgggctcagcctgagggcccctcactgtgtctgtgg

SEQ ID NO: 257 - DNA, 33 bp, Artificial Sequence
  primer
ttggcgcgcctgtcgtctgtgtttgcaggtgtc

SEQ ID NO: 258 - DNA, 62 bp, Artificial Sequence
  primer
ttgcacgcgtgcagggaggtttgtgtctgggctcagcctgagggcccctcactgtgtctctc

SEQ ID NO: 259 - DNA, 40 bp, Artificial Sequence
  primer
ttggcgcgcctgtcgtctgtgtttgcaggtgtccagtgtg

SEQ ID NO: 260 - DNA, 62 bp, Artificial Sequence
  primer
ttgcacgcgtgcagggaggtttgtgtctgggctcagcctgagggcccctcactgtgtctttc

SEQ ID NO: 261 - DNA, 40 bp, Artificial Sequence
  primer
ttggcgcgcctgtcgtctgtgtttgcaggtgtccagtgtc

SEQ ID NO: 262 - DNA, 63 bp, Artificial Sequence
  primer
ttgcacgcgtgcagggaggtttgtgtctgggctcagcctgagggcccctcactgtgtctttcg

SEQ ID NO: 263 - DNA, 34 bp, Artificial Sequence; identical to SEQ ID NO: 249
  primer

SEQ ID NO: 264 - DNA, 68 bp, Artificial Sequence
  primer
ttgcacgcgtgcagggaggtttgtgtctgggctcagcctgagggcccctcactgtgtctcttttgcac

SEQ ID NO: 265 - DNA, 34 bp, Artificial Sequence; identical to SEQ ID NO: 249
  primer

SEQ ID NO: 266 - DNA, 66 bp, Artificial Sequence
  primer
ttgcacgcgtgcagggaggtttgtgtctgggctcagcctgagggcccctcactgtgtctctcgcac

SEQ ID NO: 267 - DNA, 34 bp, Artificial Sequence; identical to SEQ ID NO: 249
  primer

SEQ ID NO: 268 - DNA, 62 bp, Artificial Sequence
  primer
ttgcacgcgtgcagggaggtttgtgtctgggctcagcctgagggcccctcactgtgtctccg

SEQ ID NO: 269 - DNA, 34 bp, Artificial Sequence
  primer
ttggcgcgcctgtcgtctgtgtttgcaggtttcc

SEQ ID NO: 270 - DNA, 66 bp, Artificial Sequence
  primer
ttgcacgcgtgcagggaggtttgtgtctgggctcagcctgagggcccctcactgtgtctctagcac

SEQ ID NO: 271 - DNA, 28 bp, Artificial Sequence
  primer
ttggcgcgccaggggagtgcggctccac

SEQ ID NO: 272 - DNA, 32 bp, Artificial Sequence
  primer
ttgcacgcgttggtcaggacactgtcactcac

SEQ ID NO: 273 - DNA, 28 bp, Artificial Sequence
  primer
ttggcgcgccaggggcgcgcggctccac

SEQ ID NO: 274 - DNA, 38 bp, Artificial Sequence
  primer
ttgcacgcgttgatcacgaaactgtcactcacactctc

SEQ ID NO: 275 - DNA, 28 bp, Artificial Sequence
  primer
ttggcgcgccaggggcgcgcggctccac

SEQ ID NO: 276 - DNA, 40 bp, Artificial sequence
  primer
ttgcacgcgttctgttggtctcttcttctcttgctataac

SEQ ID NO: 277 - DNA, 28 bp, Artificial Sequence
  primer
ttggcgcgccaggggagtgcggctccac

SEQ ID NO: 278 - DNA, 32 bp, Artificial Sequence
  primer
ttgcacgcgttggtcaagacactgtcactcac

SEQ ID NO: 279 - DNA, 28 bp, Artificial Sequence
  primer
ttggcgcgccagggacgcacggctccac

SEQ ID NO: 280 - DNA, 32 bp, Artificial Sequence
  primer
ttgcacgcgttggtcaggaagctgtcactcac

SEQ ID NO: 281 - DNA, 28 bp, Artificial Sequence
  primer
ttggcgcgccagggatgcgcggctccag

SEQ ID NO: 282 - DNA, 34 bp, Artificial Sequence
  primer
ttgcacgcgttggtcaggacactgtcactgacac

SEQ ID NO: 283 - DNA, 28 bp, Artificial Sequence
  primer
ttggcgcgccaggggagtgcggctccac

SEQ ID NO: 284 - DNA, 36 bp, Artificial sequence
  primer
ttgcacgcgttggtcaggaagctgtcactcactctc

SEQ ID NO: 285 - DNA, 27 bp, Artificial Sequence
  primer
ttggcgcgccggggcccgcggctccac

SEQ ID NO: 286 - DNA, 28 bp, Artificial Sequence
  primer
ttgcacgcgttggtcaggaagctgtcac

SEQ ID NO: 287 - DNA, 28 bp, Artificial Sequence
  primer
ttggcgcgccagggacgtgaggctctac

SEQ ID NO: 288 - DNA, 28 bp, Artificial Sequence
  primer
ttgcacgcgttggtcagggcactgtcac

SEQ ID NO: 289 - DNA, 41 bp, Artificial Sequence; identical to SEQ ID NO: 217
  primer

SEQ ID NO: 290 - DNA, 41 bp, Artificial Sequence
  primer
cgccggccggtagctaccgcgcggaagctttgcgcattcga

SEQ ID NO: 291 - DNA, 40 bp, Artificial Sequence
  primer
cggccggccatcgatggcgcgccttcgaaacgcgtggtac

SEQ ID NO: 292 - DNA, 40 bp, Artificial Sequence
  primer
tcgagccggccggtagctaccgcgcggaagctttgcgcac

SEQ ID NO: 293 - DNA, 32 bp, Artificial Sequence; identical to SEQ ID NO: 215
  primer

SEQ ID NO: 294 - DNA, 30 bp, Artificial Sequence; identical to SEQ ID NO: 216
  primer

SEQ ID NO: 295 - DNA, 33 bp, Artificial Sequence
  primer
ccaggccggccattacaccagtgtcagtaagcg

SEQ ID NO: 296 - DNA, 35 bp, Artificial Sequence
  primer
ccaggcgcgcctcagaagaactcgtcaagaaggcg

SEQ ID NO: 297 - DNA, 58 bp, Artificial Sequence
  primer
gatccggccggccatcgatggcgcgccttcgaaacgcgttagggataacagggtaata

SEQ ID NO: 298 - DNA, 57 bp, Artificial Sequence
  primer
gccggccggtagctaccgcgcggaagctttgcgcaatccctattgtcccattatcga

SEQ ID NO: 299 - DNA, 80 bp, Artificial Sequence
  primer
atctgcactcagtgcgtcttgagcgccccctggtagagccgcgcgaccctggcgcgccattacaccagtgtcagtaagcg

SEQ ID NO: 300 - DNA, 82 bp, Artificial Sequence
  primer
aaatgaccagtctgacagccgcggacacggccacctatttctgtgcgagaggccggcctcagaagaactcgtcaagaaggcg

SEQ ID NO: 301 - DNA, 76 bp, Artificial Sequence
  primer
gatgtccactggtacctaagcctcgccctctgtgcttcttccctcctcaggaactgtggctgcaccatctgtcttc

SEQ ID NO: 302 - DNA, 79 bp, Artificial Sequence
  primer
gaggctgggcctcagggtcgctggcggtgccctggcaggcgtctcgctctaacactctcccctgttgaagctctttgtg

SEQ ID NO: 303 - DNA, 96 bp, Artificial Sequence
  primer
ctttctctgtccttcctgtgcgacggttacgccgctccatgagcttatcgtaactataacggtcctaaggtagcgatggacagcaagcgaaccgga

SEQ ID NO: 304 - DNA, 71 bp, Artificial Sequence
  primer
ggaccagtttacaatcccacctgccatctaagaaagctggtctcatcgtgtcagaagaactcgtcaagaag

SEQ ID NO: 305 - DNA, 91 bp, Artificial Sequence
  primer
ccccccccgccacttctcttctgtttcgtttaagttctacactgacatactagggataacagggtaataacgtttacaatttcgcctgatg

SEQ ID NO: 306 - DNA, 80 bp, Artificial Sequence
  primer
agtgggtaggcctggcggccgcctggccgtcgacatttaggtgacactatagaaggatcctagcacgtgtcagtcctgct

SEQ ID NO: 307 - DNA, 96 bp, Artificial Sequence
  primer
ttacgccaagctatttaggtgacactatagaatactcaagctttgattgctaactataacggtcctaaggtagcgatgaaggcacgaacccagttg

SEQ ID NO: 308 - DNA, 89 bp, Artificial Sequence
  primer
gcggaattctatgtctagtggagggtgaagctggtgattatagagtgaaaattaccctgttatccctatcggcttgaacgaattgttag

SEQ ID NO: 309 - DNA, 73 bp, Artificial Sequence
  primer
cataaatatactgtcttccaggatcttagagctcacctaaggaaacaagagttcatttgaagtttttaaagtg

SEQ ID NO: 310 - DNA, 74 bp, Artificial Sequence
  primer
actccagaagttcctatactttctagagaataggaacttcggaataggaacttcctttgatctccaccttggtc

SEQ ID NO: 311 - DNA, 69 bp, Artificial Sequence
  primer
gaagttcctattccgaagttcctattctctagaaagtataggaacttctggagttgtagatcctctacg

SEQ ID NO: 312 - DNA, 120 bp, Artificial Sequence
  primer
aaaacaaaccaatcaggcagaaacggtgaggaatcagtgaaacggccacttacgaagttcctatactttctagagaataggaacttcggaataggaacttcaagatgcgtgatctgatcc

SEQ ID NO: 313 - DNA, 20 bp, Artificial Sequence
  primer
ttatgctgcatccagtttgc

SEQ ID NO: 314 - DNA, 20 bp, Artificial Sequence
  primer
aaaacaaaccaatcaggcag

SEQ ID NO: 315 - DNA, 17 bp, Artificial Sequence
  primer
tgtgacatccagatgac

SEQ ID NO: 316 - DNA, 20 bp, Artificial Sequence
  primer
aaaacaaaccaatcaggcag

SEQ ID NO: 317 - DNA, 143 bp, Artificial Sequence
  primer
ggaccagtttacaatcccacctgccatctaagaaagctggtctcatcgtggtgccagggcgtgcccttgggctgggggcgcgataacttcgtatagcatacattatacgaagttatcgatcgtggagttgtagatcctctacg

SEQ ID NO: 318 - DNA, 70 bp, Artificial Sequence
  primer
ttacgccaagctatttaggtgacactatagaatactcaagctttgattgcaagatgcgtgatctgatcct

SEQ ID NO: 319 - DNA, 87 bp, Artificial Sequence
  primer
cgggatccgcgcgtacggaagttcctataccttttgaagaataggaacttcggaataggaacttcattacaccagtgtcagtaagcg

SEQ ID NO: 320 - DNA, 64 bp, Artificial Sequence
  primer
gggaagcttcgcgcgatcgccgctttcgcaaaggcgcgcctcagaagaactcgtcaagaaggcg

SEQ ID NO: 321 - DNA, 71 bp, Artificial Sequence
  primer
ggcggccgcctggccgtcgacatttaggtgacactatagaaggatccgcgtggagttgtagatcctctacg

SEQ ID NO: 322 - DNA, 76 bp, Artificial Sequence
  primer
aactcagtaaggaaaaggactgggaaagtgcacttacatttgatctccaggcgcgccaagatgcgtgatctgatcc

SEQ ID NO: 323 - DNA, 158 bp, Artificial Sequence
  primer
ggaccagtttacaatcccacctgccatctaagaaagctggtctcatcgtggtgccagggcgtgcccttgggctgggggcgcggaagttcctattccgaagttcctattcttcaaaaggtataggaacttccgtacgattacaccagtgtcagtaagcg

SEQ ID NO: 324 - DNA, 74 bp, Artificial Sequence
  primer
ggactgatgggaaaatagaggagaaaattgaccagaggaagtgcagatggtcagaagaactcgtcaagaaggcg

SEQ ID NO: 325 - DNA, 69 bp, Artificial Sequence
  primer
aacctgaagattttgcaacttactactgtcaacagagttacagtaccccttccacagtgatacaagccc

SEQ ID NO: 326 - DNA, 71 bp, Artificial Sequence
  primer
tgccggccacgatgcgtccggcgtagaggatctacaactccaggcgcgcctggtcatgtcagtgctgctgc

SEQ ID NO: 327 - DNA, 71 bp, Artificial Sequence
  primer
ctcctttcctcctccttggtggcagcagcactgacatgaccaggcgcgcctggagttgtagatcctctacg

SEQ ID NO: 328 - DNA, 75 bp, Artificial Sequence
  primer
tgtaatacgactcactatagggcgaattcgagctcggtacccggggatcccgtacgaagatgcgtgatctgatcc

SEQ ID NO: 329 - DNA, 82 bp, Artificial Sequence
  primer
ggcggccgcctggccgtcgacatttaggtgacactatagaaggatccgcgaccctgttatccctagatttaaatgatatcgg

SEQ ID NO: 330 - DNA, 135 bp, Artificial Sequence
  primer
aactttctcctacagatcccagataaccatgaatttattacaccatcttgggcgcgccgaagttcctatactttctagagaataggaacttcggaataggaacttcagttggtgattttgaacttttgctttgcc

SEQ ID NO: 331 - DNA, 157 bp, Artificial Sequence
  primer
ggaccagtttacaatcccacctgccatctaagaaagctggtctcatcgtggtgccagggcgtgcccttgggctgggggcgcggcgatcgcgaagttcctattccgaagttcctattcttcaaaaggtataggaacttctacggggtctgacgctcag

SEQ ID NO: 332 - DNA, 76 bp, Artificial Sequence
  primer
gaattcagagctcaatgagttgccttgttcagagctctattttcacttgacgtacgacagacaagctgtgaccgtc

SEQ ID NO: 333 - DNA, 69 bp, Artificial Sequence
  primer
gagttaggcctcagagctgaggcagggctcggttccccttgggtgagaagggtttctgttcagcaagac

SEQ ID NO: 334 - DNA, 69 bp, Artificial Sequence
  primer
tggccaattagagcaaaatttcagacagtaataggaaaaaggtacttacgtttaatctccagtcgtgtc

SEQ ID NO: 335 - DNA, 17 bp, Artificial Sequence
  primer
tcagtactgactggaac

SEQ ID NO: 336 - DNA, 18 bp, Artificial Sequence
  primer
ccaatgactttcaaaacc

SEQ ID NO: 337 - DNA, 16 bp, Artificial Sequence
  primer
ccgtacagcctggctc

SEQ ID NO: 338 - DNA, 18 bp, Artificial Sequence
  primer
aacaccatcagagtgtgc

SEQ ID NO: 339 - DNA, 19 bp, Artificial Sequence
  primer
atgattaattgtgtggacc

SEQ ID NO: 340 - DNA, 18 bp, Artificial Sequence
  primer
aggtgatctcatatcctc

SEQ ID NO: 341 - DNA, 18 bp, Artificial Sequence
  primer
ctcagtactgctttactg

SEQ ID NO: 342 - DNA, 18 bp, Artificial Sequence
  primer
tgacttcatgtccccttc

SEQ ID NO: 343 - DNA, 21 bp, Artificial Sequence
  primer
acatgattaattgtgtggacc

SEQ ID NO: 344 - DNA, 18 bp, Artificial Sequence
  primer
ggtgcagaggtgacttcg

SEQ ID NO: 345 - DNA, 21 bp, Artificial Sequence
  primer
ctcagtactgctttactattc

SEQ ID NO: 346 - DNA, 18 bp, Artificial Sequence
  primer
gaggaacactctcagctg

SEQ ID NO: 347 - DNA, 19 bp, Artificial Sequence
  primer
cagggaacttctcttacag

SEQ ID NO: 348 - DNA, 18 bp, Artificial Sequence
  primer
gaattagggtgcagaggc

SEQ ID NO: 349 - DNA, 18 bp, Artificial Sequence
  primer
tactattcagggaaattc

SEQ ID NO: 350 - DNA, 17 bp, Artificial Sequence
  primer
tgtctgtgaagttggtg

SEQ ID NO: 351 - DNA, 17 bp, Artificial Sequence
  primer
tggctcttgatggaagc

SEQ ID NO: 352 - DNA, 18 bp, Artificial Sequence
  primer
acttcaaagtgtgactgc

SEQ ID NO: 353 - DNA, 19 bp, Artificial Sequence
  primer
agggaacttctcttacagc

SEQ ID NO: 354 - DNA, 18 bp, Artificial Sequence
  primer
aattagggtgcagaggcg

SEQ ID NO: 355 - DNA, 22 bp, Artificial Sequence
  primer
gaagtcttcctataatatgatc

SEQ ID NO: 356 - DNA, 18 bp, Artificial Sequence
  primer
tggctgcatctgaggacc

SEQ ID NO: 357 - DNA, 18 bp, Artificial Sequence
  primer
gccactaatgcctggcac

SEQ ID NO: 358 - DNA, 18 bp, Artificial Sequence
  primer
ctgctgtcagcagagggc

SEQ ID NO: 359 - DNA, 18 bp, Artificial Sequence
  primer
cttcttataacatgatgg

SEQ ID NO: 360 - DNA, 16 bp, Artificial Sequence
  primer
aaacgctctgagcagc

SEQ ID NO: 361 - DNA, 18 bp, Artificial Sequence
  primer
ctcagtactgctttactg

SEQ ID NO: 362 - DNA, 18 bp, Artificial Sequence
  primer
gaggaacaatctcagccg

SEQ ID NO: 363 - DNA, 18 bp, Artificial Sequence
  primer
agccaggctgtacggaac

SEQ ID NO: 364 - DNA, 18 bp, Artificial Sequence
  primer
cccagcctcacacatctc

SEQ ID NO: 365 - DNA, 16 bp, Artificial Sequence
  primer
tggcccttcagggaag

SEQ ID NO: 366 - DNA, 18 bp, Artificial Sequence
  primer
accatcagagtgtggttg

SEQ ID NO: 367 - DNA, 18 bp, Artificial Sequence
  primer
ccagtgtagccattaatg

SEQ ID NO: 368 - DNA, 18 bp, Artificial Sequence
  primer
taccaaaacttcccaggg

SEQ ID NO: 369 - DNA, 18 bp, Artificial Sequence
  primer
gggaaattctcttactac

SEQ ID NO: 370 - DNA, 16 bp, Artificial Sequence
  primer
ccccctctaccaatac

SEQ ID NO: 371 - DNA, 18 bp, Artificial Sequence
  primer
ccattcagggaagtcttc

SEQ ID NO: 372 - DNA, 18 bp, Artificial Sequence
  primer
tgagtctgagaagtgttg

SEQ ID NO: 373 - DNA, 18 bp, Artificial Sequence
  primer
ggaattttcttagcccac

SEQ ID NO: 374 - DNA, 18 bp, Artificial Sequence
  primer
atgttcaggcttgtaacc

SEQ ID NO: 375 - DNA, 18 bp, Artificial Sequence
  primer
tcatcttacaaatagttg

SEQ ID NO: 376 - DNA, 15 bp, Artificial Sequence
  primer
tctgaccattcctgc

SEQ ID NO: 377 - DNA, 21 bp, Artificial Sequence
  primer
gggaaatcatcttataaatag

SEQ ID NO: 378 - DNA, 18 bp, Artificial Sequence
  primer
tgcagatgagacttctgg

SEQ ID NO: 379 - DNA, 18 bp, Artificial Sequence
  primer
attcaggaaagtcctctc

SEQ ID NO: 380 - DNA, 17 bp, Artificial Sequence
  primer
cagtgaccttcagagtg

SEQ ID NO: 381 - DNA, 18 bp, Artificial Sequence
  primer
attcaggaaagtcctctc

SEQ ID NO: 382 - DNA, 17 bp, Artificial Sequence
  primer
cagtgaccttcagagtg

SEQ ID NO: 383 - DNA, 45 bp, Artificial Sequence
  primer
ttggcgcgccttctgtttcccttctcaggtgccagatgtgacatc

SEQ ID NO: 384 - DNA, 67 bp, Artificial Sequence
  primer
cgcacgcgtgtttgatctccaccttggtccctccgccgaaagtgagaggggtactgtaactctgttg

SEQ ID NO: 385 - DNA, 45 bp, Artificial Sequence; identical to SEQ ID NO: 383
  primer

SEQ ID NO: 386 - DNA, 61 bp, Artificial Sequence
  primer
cgcacgcgtcctggggggtttttgttagggcttgtatcactgtgggagggtaactattaag

SEQ ID NO: 387 - DNA, 45 bp, Artificial Sequence
  primer
ttggcgcgccttctgtttcccttctcaggtgccagatgtgccatc

SEQ ID NO: 388 - DNA, 62 bp, Artificial Sequence
  primer
cgcacgcgtcctggggggtttttgttagggcttgtatcactgtgggagggtaactattaaac

SEQ ID NO: 389 - DNA, 45 bp, Artificial Sequence
  primer
ttggcgcgccttctgtttcccttctcaggtgccaggtgtgacatc

SEQ ID NO: 390 - DNA, 62 bp, Artificial Sequence
  primer
cgcacgcgtcctggggggtttttgttagggcttgtatcactgtgggagggtaactattatgc

SEQ ID NO: 391 - DNA, 45 bp, Artificial Sequence; identical to SEQ ID NO: 387
  primer

SEQ ID NO: 392 - DNA, 61 bp, Artificial Sequence
  primer
cgcacgcgtcctggggggtttttgttagggcttgtatcactgtgggagggtaattgtaatc

SEQ ID NO: 393 - DNA, 45 bp, Artificial Sequence; identical to SEQ ID NO: 383
  primer

SEQ ID NO: 394 - DNA, 62 bp, Artificial Sequence
  primer
cgcacgcgtcctggggggtttttgttagggcttgtatcactgtgggagggtaactattatac

SEQ ID NO: 395 - DNA, 45 bp, Artificial Sequence
  primer
ttggcgcgccttctgtttcccttctcaggttccagatgcgacatc

SEQ ID NO: 396 - DNA, 60 bp, Artificial Sequence
  primer
cgcacgcgtcctggggggtttttgttagggcttgtatcactgtgggagggaaactgttag

SEQ ID NO: 397 - DNA, 45 bp, Artificial Sequence; identical to SEQ ID NO: 383
  primer

SEQ ID NO: 398 - DNA, 62 bp, Artificial Sequence; identical to SEQ ID NO: 394
  primer

SEQ ID NO: 399 - DNA, 45 bp, Artificial Sequence; identical to SEQ ID NO: 383
  primer

SEQ ID NO: 400 - DNA, 62 bp, Artificial Sequence
  primer
cgcacgcgtcctggggggtttttgttagggcttgtatcactgtgggagggagattatcatac

SEQ ID NO: 401 - DNA, 45 bp, Artificial Sequence; identical to SEQ ID NO: 395
  primer

SEQ ID NO: 402 - DNA, 60 bp, Artificial Sequence; identical to SEQ ID NO: 396
  primer

SEQ ID NO: 403 - DNA, 45 bp, Artificial Sequence
  primer
ttggcgcgccttctgtttcccttctcaggtgccaaatgtgacatc

SEQ ID NO: 404 - DNA, 62 bp, Artificial Sequence
  primer
cgcacgcgtcctggggggtttttgttagggcttgtatcactgtgggagaataactattatac

SEQ ID NO: 405 - DNA, 46 bp, Artificial Sequence
  primer
ttggcgcgccttctgtttcccttctcagataccagatgtgacatcc

SEQ ID NO: 406 - DNA, 62 bp, Artificial Sequence
  primer
cgcacgcgtcctggggggtttttgttagggcttgtatcactgtgggaggggcactgttatac

SEQ ID NO: 407 - DNA, 45 bp, Artificial Sequence; identical to SEQ ID NO: 383
  primer

SEQ ID NO: 408 - DNA, 60 bp, Artificial Sequence
  primer
cgcacgcgtcctggggggtttttgttagggcttgtatcactgtgggaggggcattgtaag

SEQ ID NO: 409 - DNA, 46 bp, Artificial Sequence
  primer
ttggcgcgccttctgtttcccttctcaggtgccagatgtaacatcc

SEQ ID NO: 410 - DNA, 62 bp, Artificial Sequence; identical to SEQ ID NO: 390
  primer

SEQ ID NO: 411 - DNA, 45 bp, Artificial Sequence; identical to SEQ ID NO: 387
  primer

SEQ ID NO: 412 - DNA, 62 bp, Artificial Sequence
  primer
cgcacgcgtcctggggggtttttgttagggcttgtatcactgtgggaggggtactataatac

SEQ ID NO: 413 - DNA, 45 bp, Artificial Sequence; identical to SEQ ID NO: 387
  primer

SEQ ID NO: 414 - DNA, 62 bp, Artificial Sequence
  primer
cgcacgcgtcctggggggtttttgttagggcttgtatcactgtgggagggtaactataatac

SEQ ID NO: 415 - DNA, 46 bp, Artificial Sequence; identical to SEQ ID NO: 405
  primer

SEQ ID NO: 416 - DNA, 62 bp, Artificial Sequence; identical to SEQ ID NO: 406
  primer

SEQ ID NO: 417 - DNA, 45 bp, Artificial Sequence
  primer
ttggcgcgccttctgtttcccttctcaggtgccagatgtgtcatc

SEQ ID NO: 418 - DNA, 62 bp, Artificial Sequence
  primer
cgcacgcgtcctggggggtttttgttagggcttgtatcactgtgggagggaaactataatac

SEQ ID NO: 419 - DNA, 45 bp, Artificial Sequence
  primer
ttggcgcgccttctgtttcccttctcagggaccagaagtgacatc

SEQ ID NO: 420 - DNA, 62 bp, Artificial Sequence
  primer
cgcacgcgtcctggggggtttttgttagggcttgtatcactgtgggagggtaatttttatac

SEQ ID NO: 421 - DNA, 46 bp, Artificial Sequence
  primer
ttggcgcgccttctgtttcccttctcaggtgtcagatttgacatcc

SEQ ID NO: 422 - DNA, 61 bp, Artificial Sequence
  primer
cgcacgcgtcctggggggtttttgttagggcttgtatcactgtgggagggtaactgaagtc

SEQ ID NO: 423 - DNA, 46 bp, Artificial Sequence
  primer
ttggcgcgccttctgtttcccttctcaggagtcagatgtgatttcc

SEQ ID NO: 424 - DNA, 60 bp, Artificial Sequence
  primer
cgcacgcgtcctggggggtttttgttagggcttgtatcactgtgggatggctgctgtaag

SEQ ID NO: 425 - DNA, 46 bp, Artificial Sequence; identical to SEQ ID NO: 423
  primer

SEQ ID NO: 426 - DNA, 60 bp, Artificial Sequence; identical to SEQ ID NO: 424
  primer

SEQ ID NO: 427 - DNA, 46 bp, Artificial Sequence
  primer
ttggcgcgccttctgtttcccttctcaggtgccagatatgacatgc

SEQ ID NO: 428 - DNA, 62 bp, Artificial Sequence
  primer
cgcacgcgtcctggggggtttttgttagggcttgtatcactgtgggagggtcacttttatac

SEQ ID NO: 429 - DNA, 46 bp, Artificial sequence; identical to SEQ ID NO: 427
  primer

SEQ ID NO: 430 - DNA, 62 bp, Artificial Sequence; identical to SEQ ID NO: 428
  primer

SEQ ID NO: 431 - DNA, 29 bp, Artificial Sequence
  primer
ttggcgcgccggaggaaacagaaacacag

SEQ ID NO: 432 - DNA, 26 bp, Artificial Sequence
  primer
cgcacgcgtcagctgctcgtcctggg

SEQ ID NO: 433 - DNA, 28 bp, Artificial Sequence
  primer
ttggcgcgccggagggaaacagaaacac

SEQ ID NO: 434 - DNA, 25 bp, Artificial Sequence
  primer
cgcacgcgtagctgctcctcctggg

SEQ ID NO: 435 - DNA, 30 bp, Artificial Sequence
  primer
ttggcgcgccgaagggaaacagaaacacag

SEQ ID NO: 436 - DNA, 25 bp, Artificial Sequence
  primer
cgcacgcgtagctgctcctcctggg

SEQ ID NO: 437 - DNA, 27 bp, Artificial Sequence
  primer
ttggcgcgccgagggaaacagaaacac

SEQ ID NO: 438 - DNA, 26 bp, Artificial Sequence
  primer
cgcacgcgtcagctgctgctcctggg

SEQ ID NO: 439 - DNA, 30 bp, Artificial Sequence; identical to SEQ ID NO: 435
  primer

SEQ ID NO: 440 - DNA, 25 bp, Artificial Sequence
  primer
cgcacgcgtagctgctcctcctggg

SEQ ID NO: 441 - DNA, 30 bp, Artificial Sequence
  primer
ttggcgcgccgaggagggaaacagaaacac

SEQ ID NO: 442 - DNA, 26 bp, Artificial Sequence
  primer
cgcacgcgtcagctgcccctcctggg

SEQ ID NO: 443 - DNA, 29 bp, Artificial Sequence
  primer
ttggcgcgccggaggaaacagaaacacag

SEQ ID NO: 444 - DNA, 26 bp, Artificial Sequence
  primer
cgcacgcgtccctagctgctcctggg

SEQ ID NO: 445 - DNA, 28 bp, Artificial Sequence
  primer
ttggcgcgccggagggaaacagacacac

SEQ ID NO: 446 - DNA, 26 bp, Artificial Sequence
  primer
cgcacgcgtcagctgctcctcctggc

SEQ ID NO: 447 - DNA, 30 bp, Artificial Sequence
  primer
ttggcgcgccgaagggaaagagaaacacag

SEQ ID NO: 448 - DNA, 25 bp, Artificial Sequence
  primer
cgcacgcgtagctgctcctcctggg

SEQ ID NO: 449 - DNA, 28 bp, Artificial Sequence
  primer
ttggcgcgccggagggaaacagaaacac

SEQ ID NO: 450 - DNA, 25 bp, Artificial Sequence
  primer
cgcacgcgtcccagctgctcctggg

SEQ ID NO: 451 - DNA, 79 bp, Artificial Sequence
  primer
agctcggtacccggggatcctctagagtcgacctgcaggcatgcaagcttggccggcctggagttgtagatcctctacg

SEQ ID NO: 452 - DNA, 80 bp, Artificial Sequence
  primer
aaaacaaaccaatcaggcagaaacggtgaggaatcagtgaaacggccacttacggcgcgccaagatgcgtgatctgatcc

SEQ ID NO: 453 - DNA, 156 bp, Artificial Sequence
  primer
cgttggaccagtttacaatcccacctgccatctaagaaagctggtctcatataacttcgtataatgtatgctatacgaacggtaacgcgtgaagttcctattccgaagttcctattctctagaaagtataggaacttctcagagcagattgtactg

SEQ ID NO: 454 - DNA, 69 bp, Artificial Sequence
  primer
ggacagcaagcgaaccggaattgccagctggggcgccctctggtaaggttaagatgcgtgatctgatcc

SEQ ID NO: 455 - DNA, 78 bp, Artificial Sequence
  primer
actgcacctcagcgtccccctgcccatgtcagggccgatgaagggcacagcgtacgattacaccagtgtcagtaagcg

SEQ ID NO: 456 - DNA, 82 bp, Artificial Sequence
  primer
tgtaatacgactcactatagggcgaattgagctcggtacccggggatcctgcgatcgctcagaagaactcgtcaagaaggcg

SEQ ID NO: 457 - DNA, 78 bp, Artificial Sequence
  primer
gtgttataaagggagactgagggaggcagaggctgtgctactggtacctggctgaatacttccagcactggggccagg

SEQ ID NO: 458 - DNA, 77 bp, Artificial Sequence; identical to SEQ ID NO: 214
  primer

SEQ ID NO: 459 - DNA, 24 bp, Artificial Sequence
  primer
aacaacctcagggctgaggacacc

SEQ ID NO: 460 - DNA, 33 bp, Artificial Sequence
  primer
ctgcccgttgtccctcgagatggtggcacggcc

What is claimed is:

1. An isolated nucleic acid molecule comprising two or more identical units consisting of, from 5' to 3' direction, a 5' nucleotide sequence, a human immunoglobulin heavy chain V gene segment, and a 3' nucleotide sequence, wherein said 5' nucleotide sequence and said 3' nucleotide sequence are identical or different, and comprise 20 to 1000 contiguous nucleotides of a spacer sequence from an immunoglobulin heavy chain gene of an animal generating antibody diversity primarily by gene conversion and/or hypermutation, wherein said spacer sequence is SEQ ID NO: 35, and said animal is a rabbit.

2. The isolated nucleic acid molecule of claim 1 wherein said human immunoglobulin heavy chain V gene segment is a member of the VH3, VH1, VH5, or VH4 family.

3. A recombination vector comprising a nucleic acid molecule according to claim 1.

* * * * *

UNITED STATES PATENT AND TRADEMARK OFFICE
CERTIFICATE OF CORRECTION

PATENT NO. : 7,585,668 B2  Page 1 of 1
APPLICATION NO. : 10/893483
DATED : September 8, 2009
INVENTOR(S) : Buelow et al.

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 971 days.

Signed and Sealed this

Fourteenth Day of September, 2010

David J. Kappos
*Director of the United States Patent and Trademark Office*